United States Patent 11,542,490 (RNAS FOR WOUND HEALING) - sequence listing, part 5

SEQ ID NO: 6974 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt8)
gggagagucccgcagucggcguccagcggcucugcuuguucgugugugugucguugcaggccuuauucaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6975 - RNA, 852 nt, Artificial Sequence
  mRNA product Design5 comprising derived and/or modified sequence from Homo sapiens__NP_001133.1__HsAMELX (opt8)
gggagagucccgcagucggcguccagcggcucugcuuguucgugugugugucguugcaggccuuauucaagcuuaccaugggcaccuggauccuauucgcaugccuccucggagccgccuucgccaugccccuccccccccaccccggccaccccggcuacaucaacuucucuuacgaaguccucaccccccuaaaaugguaccaaucaauucgcccccccuauccauccuacggcuacgaacccaugggcggcuggcuacaccaccaaauaauacccguccucucccaacaacacccccccacccacacccuccaaccccaccaccacauccccgucguccccgcacaacaacccgucaucccccaacaaccaaugaugccagucccaggccaacacucuaugacccccauccaacaccaccaacccaaccuccccccccccgcacaacaaccauaccaaccccaacccguccaaccacaaccccaccaacccaugcaaccccaaccccccguccaccccaugcaaccccucccaccccaaccaccccucccccccauguuccccaugcaaccccucccccccaugcuacccgaccuaacccucgaagccuggcccuccacagacaaaacaaaacgagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6976 - RNA, 411 nt, Artificial Sequence
  mRNA product Design5 comprising derived and/or modified sequence from Homo sapiens__NP_001133.1__HsAMELX-TRAP (opt8)
gggagagucccgcagucggcguccagcggcucugcuuguucgugugugugucguugcaggccuuauucaagcuuaccaugccccucccaccccaccccggccaccccggauacauaaacuucuccuacgaaguccuaacaccccuaaaaugguaccaauccauacgcccacccuaccccuccuacggcuacgaacccaugggcggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6977 - RNA, 444 nt, Artificial Sequence
  mRNA product Design5 comprising derived and/or modified sequence from Homo sapiens__NP_001133.1__HsAMELX-LRAP (opt8)
gggagagucccgcagucggcguccagcggcucugcuuguucgugugugugucguugcaggccuuauucaagcuuaccaugccccucccaccccaccccggccaccccggcuacauaaacuucuccuacgaaguccucacaccacucaaaugguaccaauccauccgcccaccacccaugcuccccgaccucacccucgaagccuggcccuccaccgacaaaacaaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6978 - RNA, 483 nt, Artificial Sequence
  mRNA product Design5 comprising derived and/or modified sequence from Homo sapiens__NP_001133.1__HLA-A2-SP_HsAMELX(17-60) (opt8)
gggagagucccgcagucggcguccagcggcucugcuuguucgugugugugucguugcaggccuuauucaagcuuaccauggccgucauggcaccccgaacccuaguccuacuccuauccggcgcccuagcccucacccaaaccugggccaugccacuaccaccccacccaggccaccccggcuacaucaacuucuccuacgaaguacucacaccacuaaaaugguaccaauccauccgaccacccuaccccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6979 - RNA, 516 nt, Artificial Sequence
  mRNA product Design5 comprising derived and/or modified sequence from Homo sapiens__NP_001133.1__HLA-A2-SP_HsAMELX(17-47,168-191) (opt8)
gggagagucccgcagucggcguccagcggcucugcuuguucgugugugugucguugcaggccuuauucaagcuuaccauggccguaauggcaccccgaacacucguacuccuccucuccggagcacuagcccucacccaaaccugggccaugccccuccccccacaccccggccaccccggcuacauaaauuucuccuacgaaguccucaccccccucaaaugguaccaauccauccgccccccccccaugcuccccgaccuaacacucgaagccuggcccucaaccgacaaaacaaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6980 - RNA, 855 nt, Artificial Sequence
  mRNA product Design5 comprising derived and/or modified sequence from Homo sapiens__NP_001134.1__HsAMELY (opt8)
gggagagucccgcagucggcguccagcggcucugcuuguucgugugugugucguugcaggccuuauucaagcuuaccaugggcaccuggauccuauucgcaugccuagucggcgccgccuucgccaugccccucccaccccaccccggccaccccggcuacaucaacuucuccuacgaaguacucaccccacucaaaugguaccaauccaugauacgcccacccuacuccuccuacggauacgaacccaugggcggcuggcuccaccaccaaauaauccccgucguuucccaacaacacccccucacccacacccuccaaucacaccaccacauccccguaguccccgcccaacaaccccgaguccgccagcaagcccucaugcccguaccaggccaacaaucaaugacccccacccaacaccaccaacccaaccucccccuccccgcccaacaacccuuccaaccccaacccguccaaccccaaccacaccaaccaaugcaaccccaaccacccguccaacccaugcaaccccuucucccccaaccuccccuaccacccauguucccccuccguccucucccacccauccuccccgaccuccaccucgaagccuggcccgccaccgacaaaaccaaacaagaagaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6981 - RNA, 414 nt, Artificial Sequence
  mRNA product Design5 comprising derived and/or modified sequence from Homo sapiens__NP_001134.1__HsAMELY-TRAP (opt8)
gggagagucccgcagucggcguccagcggcucugcuuguucgugugugugucguugcaggccuuauucaagcuuaccaugccccuaccaccccaccccggccaccccggcuacauaaacuucuccuacgaaguccucaccccacucaaaugguaccaaucaaugauacgaccacccuacuccucauacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6982 - RNA, 447 nt, Artificial Sequence
  mRNA product Design5 comprising derived and/or modified sequence from Homo sapiens__NP_001134.1__HsAMELY-LRAP (opt8)
gggagagucccgcagucggcguccagcggcucugcuuguucgugugugugucguugcaggccuuauucaagcuuaccaugccccuccccccacaccccggccaccccggcuacauaaacuucuccuacgaaguccuaacaccacucaaaugguaccaauccaugauccgccccccccccauacuccccgaccuccaccucgaagccuggcccgccacagacaaaaccaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6983 - RNA, 486 nt, Artificial Sequence
  mRNA product Design5 comprising derived and/or modified sequence from Homo sapiens__NP_001134.1__HLA-A2-SP_HsAMELY(17-61) (opt8)
gggagagucccgcagucggcguccagcggcucugcuuguucgugugugugucguugcaggccuuauucaagcuuaccauggccgucauggccccacgcacacucguccuccuacucucaggagcccucgcacucacacaaaccugggccaugccacucccaccacaccccggccaccccggcuacaucaacuucucauacgaaguccucaccccacucaaaugguaccaaucaaugauacgcccacccuacuccuccuacggcuacgaacccaugggcggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6984 - RNA, 519 nt, Artificial Sequence
  mRNA product Design5 comprising derived and/or modified sequence from Homo sapiens__NP_001134.1__HLA-A2-SP_HsAMELY(17-48,169-192) (opt8)
gggagagucccgcagucggcguccagcggcucugcuuguucgugugugugucguugcaggccuuauucaagcuuaccauggcagucauggcaccccgcacccucguccuacuacucuccggcgcccucgcccucacccaaacaugggccaugccacucccaccccaccccggacaccccggcuacaucaacuucucauacgaaguccucaccccacucaaaugguaccaauccaugauccgacccccacccauccuacccgaccuccaccucgaagccuggcccgccaccgacaaaaccaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6985 - RNA, 846 nt, Artificial Sequence
  mRNA product Design5 comprising derived and/or modified sequence from Sus scrofa__NP_999071.1__SsAMELX-001-1 (opt8)
gggagagucccgcagucggcguccagcggcucugcuuguucgugugugugucguugcaggccuuauucaagcuuaccaugggcaccuggauccucuucgcaugccuccucggcgccgccuucuccaugccucuaccaccccaccccggccaccccggcuacauuaacuucuccuacgaaguccuaacuccccuaaaaugguaccaaaacaugauccgacaccccuacaccuccuacggauacgaacccaugggcggauggcuccaccaccaaaucauccccgucgucucccaacaaacaccccaaucccacgcccuacaaccccaccaccacauccccaugguacccgcccaacaacccgguauaccccaacaacccaugaugccccuccccggccaacacucaaugacccccacccaacaccaccaacccaaccuaccccuacccgcacaacaacccuuccaaccccaaccaguccaaccccaaccccaccaaccacuccaaccccaaucccccaugcaccccauccaaccccuccucccacaaccaccccucccacccauguucuccaugcaaucacuccuccccgaccucccccucgaagccuggcccgcaaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6986 - RNA, 414 nt, Artificial Sequence
  mRNA product Design5 comprising derived and/or modified sequence from Sus scrofa__NP_999071.1__SsAMELX-TRAP (opt8)
gggagagucccgcagucggcguccagcggcucugcuuguucgugugugugucguugcaggccuuauucaagcuuaccaugccccuaccaccccacccaggccaccccggcuacaucaacuucuccuacgaaguccucacaccacucaaaugguaccaaaacaugaucagacacccauacaccucauacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6987 - RNA, 447 nt, Artificial Sequence
  mRNA product Design5 comprising derived and/or modified sequence from Sus scrofa__NP_999071.1__SsAMELX-LRAP (opt8)
gggagagucccgcagucggcguccagcggcucugcuuguucgugugugugucguugcaggccuuauucaagcuuaccaugccacuacccccacaccccggccaccccggcuacauaaacuucucauacgaaguacucaccccacucaaaugguaccaaaacaugauccgacaccccucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6988 - RNA, 486 nt, Artificial Sequence
  mRNA product Design5 comprising derived and/or modified sequence from Sus scrofa__NP_999071.1__HLA-A2-SP_SsAMEL(17-61) (opt8)
gggagagucccgcagucggcguccagcggcucugcuuguucgugugugugucguugcaggccuuauucaagcuuaccauggcagucauggcaccccgcacacucguccuccuacuaucaggagcccucgcacucacacaaacaugggccaugccccuaccaccccaccccggacaccccggcuacauaaacuucuccuacgaaguccuaacaccccuaaaaugguaccaaaacaugauccgacaccccuacaccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6989 - RNA, 519 nt, Artificial Sequence
  mRNA product Design5 comprising derived and/or modified sequence from Sus scrofa__NP_999071.1__HLA-A2-SP_SsAMEL(17-49,167-189) (opt8)
gggagagucccgcagucggcguccagcggcucugcuuguucgugugugugucguugcaggccuuauucaagcuuaccauggccgucauggccccacgcacccuaguccuccuccuauccggcgcacucgcacucacacaaaccugggccaugccccucccaccacaccccggccaccccggcuacaucaacuucuccuacgaaguccucacaccccucaaaugguaccaaaacaugauccgccacccaucacuccucccagaccucccacucgaagccuggcccgccaccgacaaaaccaaacgcgaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6990 - RNA, 810 nt, Artificial Sequence
  mRNA product Design5 comprising derived and/or modified sequence from Sus scrofa__P45561-2__SsAMELX-001-2 (opt8)
gggagagucccgcagucggcguccagcggcucugcuuguucgugugugugucguugcaggccuuauucaagcuuaccaugggcaccuggauacucuucgcaugccuccucggcgccgccuucuccaugccccucccaccccaccccggccaccccggcuacaucaacuucuccuacauccgccacccauacaccuccuacggcuacgaacccaugggcggcuggcuacaccaccaaaucauccccgucgucucccaacaaacaccccaaucccacgcccuacaaccccaccaccacaucccaaugguccccgcccaacaaccaggcaucccacaacaacccaugaugccccuacccggccaacacucaaugaccccaacucaacaccaccaacccaaccuaccccuacccgcccaacaacccuuccaaccccaacccguccaaccccaaccccaccaaccccuccaaccccaaucccccaugcaccccauccaaccccuccuaccccaaccaccccucccacccauguucucaaugcaaucccuacuccccgaccuaccccucgaagcauggcccgcuacagacaaaacaaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6991 - RNA, 846 nt, Artificial Sequence
  mRNA product Design5 comprising derived and/or modified sequence from Sus scrofa__NP_998965.1__SsAMELX-001-3 (opt8)
gggagagucccgcagucggcguccagcggcucugcuuguucgugugugugucguugcaggccuuauucaagcuuaccaugggaaccuggaucuucuucgccugccuccucggcgccucccucgcaaugccccucccaccccaccccggccaccccggcuacaucaacuucuccuaugaaguacucacaccccucaaaugguaucaaaacaugauccgccaccccuacacauccuacggcuacgaacccaugggcggcuggcuacaccaccaaaucauacccgucgucucacaacaaacaccccaaucacacgcccuccaaccccaccaccacauccccaugguccccgcccaacaacccggcaucccccaacaacccaugaugccccuaccaggacaacacuccaugaccccaacccaacaucaccaaccuaaucucccccuccccgcccaacaacccuuccaaccccaacccguccaaccccaaccccaccaaccccuccaaccccaaucccccaugcacccuauccaaccccuccucccccaaccaccccucccacccauguucuccaugcaaucacuccuacccgaccucccccucgaagccuggccugccaccgacaaaacaaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6992 - RNA, 495 nt, Artificial Sequence
  mRNA product Design5 comprising derived and/or modified sequence from Sus scrofa__K7GPB2__SsAMELX-002 (opt8)
gggagagucccgcagucggcguccagcggcucugcuuguucgugugugugucguugcaggccuuauucaagcuuaccaugggcaccuggauacucuucgccugccuccucggcgccgcauucucaaugccccucccaccacacccaggccaccccggauacaucaacuucuccuacgaaguacucaccccacucaaaugguaccaaaacaugauccgacaccccucacuccuccccgaccucccccuagaagccuggccagccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6993 - RNA, 888 nt, Artificial Sequence
  mRNA product Design5 comprising derived and/or modified sequence from Sus scrofa__K7GLD0__SsAMELX-003 (opt8)
gggagagucccgcagucggcguccagcggcucugcuuguucgugugugugucguugcaggccuuauucaagcuuaccaugggcaccuggauccucuucgccugccuccuaggcgcugccuucuccaugccacucccaccccaccccggccaccccggcuacaucaacuucuccuacgaagaccuauaccucgaagccauacgcaucgaccgcaccgcauuuguccuaaccccacucaaaugguaccaaaacaugauccgacacccauacaccuccuacggcuaugaacccaugggaggcuggcuacaccaccaaaucaucccagucgucucacaacaaaccccucaaucucacgcccuccaaccacaccaccacauccccaugguccccgcccaacaacccggcaucccccaacaacccaugaugccccuccccggccaacacuccaugacccccacccaacaccaccaacccaaccucccccuccccgcacaacaacccuuccaaccccaaccaguccaaccccaaccacaccaaccccuucaaccccaaucccccaugcaccccauccaaccccuccuaccacaaccacccuuaccucccauguuuucuaugcaaucccuccuccccgaccucccccucgaagccuggcccgccaccgacaaaacaaaacgcgaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6994 - RNA, 774 nt, Artificial Sequence
  mRNA product Design5 comprising derived and/or modified sequence from Sus scrofa__K7GPE9__SsAMELX-004 (opt8)
gggagagucccgcagucggcguccagcggcucugcuuguucgugugugugucguugcaggccuuauucaagcuuaccaugggaaccuggauccuauucgccugccuccuaggagccgccuucucaaugccccuaccaccccaccccggccaccccggcuacaucaacuuuuccuacgaaguccucaccccacucaaaugguaccaaaacaugauacgccaccccacaccccaaucccacgcccuacaaccccaccaccacauccccaugguccccgcccaacaacccggcaucccccaacaacccaugaugccccuccccggccaacacuccaugacccccacccaacaccaccaacccaaccucccccuccccgcccaacaacccuuucaaccccaacccguccaaccccaaccacaccaaccacuccaaccccaaucccccaugcacccaauccaaccccuccucccccaaccaccccucccacccauguucucaaugcaaucacuacuccccgaccucccccucgaagccuggcccgccaccgacaaaaccaaaagagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6995 - RNA, 798 nt, Artificial Sequence
  mRNA product Design5 comprising derived and/or modified sequence from Sus scrofa__J9JIM4__SsAMELX-201 (opt8)
gggagagucccgcagucggcguccagcggcucugcuuguucgugugugugucguugcaggccuuauucaagcuuaccaugccucucccaccccaccccggccaccccggcuacaucaacuucuccuacgaaguccucacaccccucaaaugguaccaaaacaugauccgccaccccuacaccucauacggcuacgaacccaugggcggcuggcuccaccaccaaaucauccccgucgucucccaacaaacaccccaaucacacgcacuccaaccccaccaccacauccccaugguccccgcccaacaacccggcaucccccaacaacccaugaugccacuccccggccaacacucaaugacccccacccaacaccaccaacccaaccucccacuccccgcacaacaacccuuccaaccacaacccguacaaccccaaccccaccaaccacuccaaccccaaucccccaugcaccccauccaaccccuacucccccaaccaccccuacccccaauguucucaaugcaaucccuccuccccgaccucccccucgaagcauggccagccacagacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6996 - RNA, 3237 nt, Artificial Sequence
  mRNA product Design5 comprising derived and/or modified sequence from Homo sapiens__NP_006120.1__HsBMP1 (opt8)
gggagagucccgcagucggcguccagcggcucugcuuguucgugugugugucguugcaggccuuauucaagcuuaccaugccaggcguugcaagacuaccacuacucuuaggacuacuacuacuaccgcgaccaggacgaccccucgaccuagcagacuacaccuaugaccucgccgaagaagaugauagcgaaccgcuaaauuacaaagacccguguaaagcagcagcuuuucuaggcgacauagcccuggacgaggaagaccuucgggcguuccaaguacaacaggcaguagauuuacgccgacacacggcucgaaaaucaucaaucaaagcagccguuccaggaaacacgucaaccccaagcugucagucaacaaaugggcaaccccaacgcggagcgugcggacgauggcgaggccgcagcaggucccgcagagcagccaccucccgccccgaaagagucuggcccgauggaguaauaccguucguaauaggcggcaauuucaccggaucccagcgcgcggucuuccgccaagccaugagacacugggagaaacauaccugcgugacauuccucgaaagaacagacgaagacucauacauaguauucaccuaccgaccgugcggcugcugcagcuacguaggccgcagaggcggcgggccacaagcgaucagcaucggcaaaaacugcgacaaauucggaauagucguccacgaacucggccacguaguaggcuucuggcacgagcacacccgaccugaccgagaccgacacgucagcaucguaagagaaaacauacaaccagggcaagaauacaacuuccugaaaauggagccccaagaaguggaauccuuaggagaaaccuacgacuuugacucaaucaugcacuacgcaaggaacacauucucacgaggaauauuccucgacacaauaguucccaaguacgaagugaacgggguuaaaccuccgauuggccaaaggacaagacuaucaaagggcgacaucgcacaggcacgaaaacuguacaaaugccccgcaugcggggagacacuacaagacagcaccgggaacuucucaaguccggaauacccaaacggauacagugcucacaugcacugcguauggcggauaagcgucaccccgggcgagaaaauaauacuaaacuucacaagucuggaccuauaccggagccgccuuugcugguacgauuacguagaaguccgcgacggauucuggcgcaaagcgccacugaggggacgcuucugcggaucaaaacucccggaaccgauaguaucaaccgacucacgccucugggucgaguucagaagcagcucaaacugggucggaaaaggauucuuugcaguguacgaagcuaucugcggaggagacguaaagaaagacuaugggcacauacaaagccccaacuaccccgacgacuaccgcccuagcaaaguuugcaucuggcgcauacaagucagcgaaggcuuccacgucggccugacauuccagaguuucgaaauagaacgccaugacagcugcgccuacgauuaccucgaaguccgcgacggccacucggaaagcagcaccuuaaucggcagguacugcgguuacgaaaaaccagacgacauaaagagcaccucgagccgacucuggcuaaaauucguaagcgacggcagcauaaacaaagcgggcuuugcaguuaacuucuucaaagaaguggacgaaugcuccaggccaaaccgaggcgggugcgaacaaagaugucuaaauacacucggcagcuacaaaugcagcugcgacccgggauacgaacucgcccccgacaaaagaaggugcgaagccgccugcggaggguuccucacaaaacuaaacgggagcaucacuucaccgggauggccaaaagaauacccaccaaauaagaacugcaucuggcaacucgucgcacccacccaauaccgcaucagccuacaauucgacuucuucgaaaccgaaggcaacgacgucugcaaauacgacuucguugaaguccgcuccggacuaacagcagacagcaaacuacacgguaaauucugcggcuccgaaaagccagaagucauaacaagccaauacaacaauaugagagucgaguucaagagcgacaacaccgucagcaaaaagggauuuaaggcacacuucuucucagacaaagacgaaugcucaaaagacaacggcggcugccaacaagacugcguuaacacauucggcucauacgaaugccaaugcagaucagguuucgugcugcacgacaacaaacacgacugcaaagaagccggcugcgaccauaaaguuaccagcaccaguggaaccauaacaagccccaacuggccagacaaauacccaucgaagaaagaaugcacgugggcuaucuccagcacacccgggcaccgggucaaacucaccuucauggaaauggauaucgaaagccaaccggaaugcgcauacgaccaucuagaagucuuugacggccgagacgccaaagccccaguacucggcagauucugcggauccaagaaaccagaaccaguacucgcgaccgggagccgaauguuccuccgcuucuacagcgacaacuccgugcaacgcaaaggcuuccaagccucccaugcgacggaaugcggcggacaaguucgcgcggacgucaaaaccaaagacuuauacagccaugcacaguucggugacaacaauuaccccggaggcguagacugcgaaugggucauaguagccgaagaaggauacggcgucgagcucguauuccagacauucgaaguagaagaagaaaccgacugcggcuacgauuacauggaacuuuucgacggguacgacagcacagcgccacgccucggacgcuacugcggaucaggcccgccagaagaaguauacagcgcaggcgacuccguccuagucaaauuccauucugaugacaccaucacaaagaaaggcuuccacuugagauacacaaguacaaaauuccaagacaccuuacauucaagaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6997 - RNA, 1467 nt, Artificial Sequence
  mRNA product Design5 comprising derived and/or modified sequence from Homo sapiens__NP_001191.1__HsBMP2 (opt8)
gggagagucccgcagucggcguccagcggcucugcuuguucgugugugugucguugcaggccuuauucaagcuuaccauggucgccggaacucgcugccuccuagcccuccuacucccccaaguacuacucggcggcgccgccggccucguucccgaacucggacgacgaaaauucgccgccgcauccucuggaaggcccagcucccaacccuccgacgaaguucucuccgaguucgaacuccgccuccucucaauguucggccucaaacaacgccccacaccaucacgcgacgcagucgucccgcccuacaugcucgaccuauaccgucgucacucaggccaacccggaucccccgcccccgaccaccgucucgaacgcgcagccucgcgcgccaacacaguccgcuccuuccaccacgaagaaucccucgaagaacuacccgaaaccuccggcaaaacaacccgacgcuucuucuucaaccucagcuccauccccacagaagaguucauaaccuccgccgaacuacaaguauuccgcgaacagaugcaagacgcccucggaaacaacagcucauuccaccacagaaucaacauuuacgaaauaaucaaacccgccaccgcgaacagcaaauuucccgucacccgucuccucgacacccgccucgucaaccaaaacgccucccgcugggaaucuuuugacguaacacccgcagucaugcgcuggacagcacaaggccacgccaaccacggauucgucguagaaguagcccaccuagaagaaaagcaaggaguauccaaacgucacguacgaauaucacgcucccuacaccaagacgaacacuccuggucccaaauccgaccccuacucgucaccuucggccacgacggaaaaggacacccccuucacaaaagggaaaaacgccaagccaaacacaaacaacgcaaacgacucaaauccucaugcaaaagacacccccucuacguugauuucucagacgucggcuggaacgacuggaucguagccccacccggcuaccacgccuucuacugccacggcgaaugccccuucccccucgcagaccaccuuaauucaaccaaccacgcaaucguccaaacccucgucaacuccgucaacucaaaaauccccaaagccugcugcguccccaccgaacuaucagccaucuccauguuauaccuagacgaaaacgaaaaagugguccucaaaaacuaccaagacauggucgucgaagguugcggcugccgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6998 - RNA, 1503 nt, Artificial Sequence
  mRNA product Design5 comprising derived and/or modified sequence from Homo sapiens__NP_001193.2__HsBMP4 (opt8)
gggagagucccgcagucggcguccagcggcucugcuuguucgugugugugucguugcaggccuuauucaagcuuaccaugauacccggcaaccgcaugcucauggucguccuccucugccaaguacuccucggaggagccucacacgccucacucauaccagaaacuggcaaaaaaaaagucgcugaaauccaagggcacgccggcggccgccgcuccggccaaucccacgaacuucuuagagacuucgaagccacccuacuccaaauguucggacuccgccgccgcccccaacccuccaaaucugcaguuauacccgacuacaugcgcgaccuauaccgucuacaaucaggcgaagaagaagaagaacaaauccauaguaccggccucgaauaccccgaacgccccgccucccgcgcaaauacaguccgcucauuccaucacgaagaacaccucgagaacauccccggaacguccgaaaacuccgccuuccgauuccucuucaaccuaucauccauccccgaaaacgaagucaucuccuccgccgaacuccgccuuuuccgcgaacaagucgaccaaggccccgacugggaacgcggcuuccaccgcauaaacaucuacgaaguaaugaaaccacccgccgaggucguccccggacaccuuaucacacgccuccucgacacccgacuaguccaccacaacgucacccgaugggaaaccuucgacguaucccccgcaguccuccgcuggacccgcgaaaaacaacccaacuacggacucgccauagaaguuacacaccuccaccaaacccgaacacaccaaggccaacacguccgaaucucccgcucccucccacaaggcuccggcaacugggcccaacuccgcccccuccucguaaccuucggacacgacggacgcggacacgcccucacccgacgccgccgagccaaacgcucccccaaacaccacucacaaagagccaggaaaaaaaauaaaaauugccgccgccacucacucuacguagacuucagcgacgucggcuggaacgacuggauagucgccccccccggcuaccaagcauucuacugccauggcgacugccccuucccacucgccgaucaccuaaacagcaccaaccacgccauaguccaaacccuaguaaacuccgucaacuccagcauacccaaggcaugcugcguacccacagaacugagcgcaaucuccauguuauaccucgacgaauacgacaaaguaguacucaaaaacuaccaagaaaugguaguagaaggaugcggcugccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6999 - RNA, 1818 nt, Artificial Sequence
  mRNA product Design5 comprising derived and/or modified sequence from Homo sapiens__NP_001709.1__HsBMP6 (opt8)
gggagagucccgcagucggcguccagcggcucugcuuguucgugugugugucguugcaggccuuauucaagcuuaccaugcccggauuaggucgccgagcacaguggcucugcuggugguggggacuccucuguagcugcugcggaccccccccccuacgcccaccucuccccgccgcugccgccgccgccgccggcggccaacuacucggagacggcggaucacccggccgaacugaacaaccaccccccucaccccaauccucaagcggguuccucuaccgucgccugaaaacccaagaaaaacgcgaaaugcaaaaagaaauccuauccguccucggccucccccaccgcccccgcccccuacacggacugcaacaaccccagccaccagcccuacgucaacaagaagaacagcagcaacaacaacaauuaccaagaggagaaccacccccuggccgacugaaauccgccccacuauucaugcucgaccuauacaacgcacucagcgcagacaaugacgaagacggcgcaucagaaggagaaagacaacaaucauggccacacgaagcagccucaagcucccaacgaagacaaccaccacccggagcagcgcacccccuaaaccgcaaaucccuacuggcccccggauccggcagcggcggcgccuccccacuaaccagcgcccaagacucugcauuccuuaacgacgcagacauggucaugucauucguuaaccuggucgaauacgacaaagaauucucgccccgacaacgacaucacaaggaauucaaauucaaccucagccagauacccgaaggcgaaguagucaccgccgccgaguuccgcaucuauaaagacugcgucaugggaucauucaaaaaccaaacauuccuaaucuccaucuaccaaguacuccaagaacaccagcaccgcgacagcgaccucuuccuauuagacacccgcguagucugggccucagaagaaggcuggcucgaauucgacauaacugccaccucaaaucuuugggucgucacaccacaacacaacaugggccuccaacucuccguagucacccgugacggaguccacguacacccccgagcugccggccucgucggacgagacggccccuacgacaaacaacccuucauggucgcauucuucaaagucuccgaaguccacguccgaaccacccgcucagccuccucccgucgcaggcaacaaucccgaaaccgauccacacaaucccaagauguagccagaguauccuccgccuccgacuauaacuccuccgaacucaaaacagcaugccgcaaacacgaacucuauguauccuuccaagaccuuggauggcaagacuggaucaucgccccaaaaggauacgccgccaacuacugcgacggcgaauguucauucccucuaaacgcccacaugaacgcaaccaaccacgccaucguacaaacacuuguccaccucaugaaucccgaguacguccccaaacccugcugcgcacccaccaaacucaacgccauaucagucuuauacuucgacgacaacucaaacguaauccugaaaaaauaccgcaacauggucguucgcgcaugcggcugccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7000 - RNA, 1572 nt, Artificial Sequence
  mRNA product Design5 comprising derived and/or modified sequence from Homo sapiens__NP_001710.1__HsBMP7 (opt8)
gggagagucccgcagucggcguccagcggcucugcuuguucgugugugugucguugcaggccuuauucaagcuuaccaugcacguccguucccugagagccgccgccccccacucguuugucgcccuaugggcaccccuauuccuccuucgaucagcacuugcagacuucucccuugacaacgaaguccacucguccuucauccaccgccgccucagaucacaagaacgacgagaaaugcaacgcgaaauacuuagcauccuaggccucccccaccguccccgaccacaucuccaaggcaaacacaacucagccccaauguucaugcucgaccucuacaacgccauggccgucgaagagggcggcggacccggcggucaaggcuucuccuacccauacaaagccgucuucagcacucaaggaccaccccucgcuucccuucaagacucccacuuccuaaccgacgcagauauggucauguccuucgucaaccuagucgagcacgacaaagaauucuuccacccccgcuaccaccaccgagaauuccgcuucgaccucuccaaaauacccgaaggcgaggccgucacagcugccgaauuccgcaucuacaaagacuacauccgcgaacgcuucgacaacgaaaccuucaggaucucagucuaucaaguccuacaagaacaucucggccgcgaauccgacuuauuccuccuagacucacgcacccucugggccucagaagaaggauggcucguauucgacaucacagccacaucaaaccacugggucgucaacccccgccacaaccucggccugcagcuaucaguagaaacccucgacggacaauccaucaaccccaaacucgccggucucaucggccgacacggcccacaaaacaaacagcccuucauggucgccuucuucaaagccaccgaaguccacuuccgaagcauccgcuccaccggauccaaacaacgcucccagaaucguuccaaaaccccgaaaaaccaagaggcccuacgcauggccaacgucgcagaaaacuccucaucagaccaacgccaagccugcaaaaaacacgaacuauacgucuccuuccgcgaccucggauggcaagacuggaucaucgcaccagaaggcuacgccgccuacuacugugaaggagaaugcgccuuuccucucaacuccuacaugaacgccaccaaccacgcaauuguacaaacccuaguucacuucaucaacccagaaacagucccaaaacccugcugugcccccacacaacuaaacgcaauauccguccucuacuucgacgauuccucgaacguuauccucaaaaaauaccgcaacaugguaguccgagccugcggaugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7001 - RNA, 576 nt, Artificial Sequence
  mRNA product Design5 comprising derived and/or modified sequence from Homo sapiens__NP_006264.2__HsCCL7 (opt8)
gggagagucccgcagucggcguccagcggcucugcuuguucgugugugugucguugcaggccuuauucaagcuuaccaugaaagccucagccgcccuccucugccuccuccucacagcagccgccuucuccccccaaggccucgcccaaccagucggcaucaacaccuccacaaccugcugcuaccgcuucauaaacaaaaaaauacccaaacaacgccuagaauccuaccgcagaaccacauccucacacugcccccgcgaagccgucaucuucaaaaccaaacuagacaaagaaaucugcgccgaccccacccaaaaauggguccaagacuucaugaaacaccuagacaaaaaaacacaaacccccaaacucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7002 - RNA, 3900 nt, Artificial Sequence
  mRNA product Design5 comprising derived and/or modified sequence from Homo sapiens__NP_001954.2__HsEGF (opt8)
gggagagucccgcagucggcguccagcggcucugcuuguucgugugugugucguugcaggccuuauucaagcuuaccaugcuguuaacgcuaaucauccuacuaccagucguaagcaaguucucuuuugucucccugagcgcgccccagcauugguccugcccagaaggcacccucgcaggcaauggaaacagcacaugcguaggcccggcuccauuccuaaucuucagccauggcaacagcaucuuuagaaucgacaccgagggcaccaacuacgaacaacucgugguagaugccggagugagcguaauaauggacuuccacuacaacgaaaaacgcauauauugggucgaccuagaacggcagcuccuccaaaggguauuucucaacggaucccgacaggagcgggugugcaauaucgagaaaaacgucuccggaauggcaaucaacuggaucaacgaagaagucaucuggagcaaucagcaggaaggaaucauaacagucacugauaugaagggcaauaacucccacauacuacucucagcacuaaaauaccccgccaacguagcaguagauccuguggaacgcuucaucuucuggagcucagagguagccgguagccucuacagagcggaucuugacggagugggugugaaagcacuuuuagaaacaagcgagaaaauaaccgcaguaucccuugacgugcucgacaaacgacuauuuuggauucaguacaaucgggaaggcucgaacucccuaauaugcucgugcgauuacgacggcggaagcguacacauaagcaagcaccccacgcagcacaaccucuuugcaaugucccuguucggugaccgaaucuucuacuccaccuggaaaaugaagaccauauggaucgcgaacaaacauacagggaaagauauggucagaaucaaccuacacagcuccuucgucccccuaggagaacuaaaggucguacauccacucgcccaacccaaagcggaagacgacaccugggaaccggaacaaaaauugugcaaauuaagaaaggguaauugcuccagcacugucugcgggcaagaccuccaaucacaccucugcaugugcgcggaaggguaugcccugagccgggaccgcaaauauugcgaagacgucaaugaaugcgccuucuggaaccacggauguacgcuugguugcaaaaacacacccgggagcuacuacuguaccugccccguaggcuucguccuacugccggacggcaagcggugucaucagcuagucaguugcccacgcaacguuucagaaugcagccacgacugcguccuaacauccgagggaccacucuguuucugcccagaaggcucagugcuagaaagagacggaaaaacaugcagcgggugcucaagcccagauaauggcgggugcucgcaacuaugugugccacuauccccugucuccugggaaugcgacugcuuccccggauacgaucuccaacucgacgaaaagucaugcgccgccaguggcccccaacccuuucuucuauucgccaacagccaagacauucgccacaugcacuucgacggaacagacuacggaacccucuuaucucaacagaugggcaugguuuacgccuuagaucacgacccuguggaaaacaaaauauacuucgcccacacagcacuaaaauggaucgaaagagcaaauauggacggcucacaacgagaacgccucauagaagagggcguagacguacccgaaggccuagcgguugacuggauaggcagaagguucuacuggacugaccgaggcaagucucugauagggcgcucggaccugaacggcaaacgcuccaaaaucauaacaaaggagaacaucucccaacccagaggaaucgcaguucacccaauggccaaacgacuguucuggaccgacacuggaaucaacccgcggaucgaaucuuccagucuacaggggcuggggcgucucguuauugcaucgagcgaccugauauggcccagcggcauaacgauagacuuccugacagacaaacuguacuggugcgacgcaaaacaaagcgugaucgaaauggccaaucucgacggaucaaaaagacgcagacucacacagaacgacgugggccacccuuucgcuguagccguauucgaagacuacgucugguucucagacugggccaugcccagcguaaugcgaguuaacaaacgcaccgguaaagacagaguccgucuccaaggcucaaugcuaaagccuaguucccuuguaguaguacauccacuagcuaaacccggugcagacccgugccuauaccagaacgguggaugugaacacauuugcaaaaagcgauugggaaccgccuggugcagcuguagagaaggauucaugaaagcgagugacggaaaaacaugccucgcacucgacggccaccagcuccuagccggaggggaaguagaucucaaaaaccaagugacgcccuuagacauacuaagcaaaaccagaguaucggaggacaacaucacggagagccaacacaugcuuguagcugaaaucaugguaagcgaccaagacgauugcgcgccagucggaugcagcauguacgcacggugcaucuccgaaggugaagaugcuaccugccagugccuaaaaggauuugcgggagacggcaaacuauguagcgauaucgacgaaugcgaaaugggagucccugucuguccgccagcaagcuccaaaugcaucaacaccgagggagguuacguaugccgaugcuccgagggauaucaaggagacggcauacacugccucgacauagacgaaugccaacugggagagcacuccugcggcgaaaacgcaagcuguaccaacacagagggcggcuacacaugcaugugcgccggccgccuaucugaacccggacucaucugccccgacucgaccccuccuccgcaccuacgugaggacgaccaccauuacagcgugcgaaauuccgacucggagugcccccuaucccacgacggauacugccuucaugacggcgucugcauguauaucgaagcccuagacaaauacgcguguaauugcguugucggcuacaucggggaacgaugccaguaccgcgaccuaaaauggugggaacuaaggcacgccgggcauggccagcagcagaaagucauagucguggcagucugcguaguggugcucgucaugcuacuccuacuaucacucuggggagcgcacuacuaccgcacccaaaaacuucuaagcaaaaaucccaaaaacccauacgaggaaucaagccgggauguucgaucgaggcgaccagcggacacagaagauggcaugagcucgugcccgcagcccugguucguggugaucaaggagcaucaagaccugaaaaacgggggacaaccaguagccggugaagacggccaagcagccgacgguagcaugcagccaaccucauggagacaagaaccacaacucugcgguaugggcacagaacagggcugcuggauucccgucucauccgacaagggcagcugcccccaaguaauggagcgauccuuccacaugccaagcuacggaacgcagacccuagaaggcgggguagaaaagccgcauucccugcugucugccaacccccuguggcaacagcgcgcacucgacccaccucaccagauggaacucacacaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7003 - RNA, 786 nt, Artificial Sequence
  mRNA product Design5 comprising derived and/or modified sequence from Homo sapiens__NP_001423.1__HsEREG (opt8)
gggagagucccgcagucggcguccagcggcucugcuuguucgugugugugucguugcaggccuuauucaagcuuaccaugaccgccggccgacgaauggaaaugcucugcgccggccguguccccgcacuucuccucugccucggauuccaccuacuccaagccguccucuccaccaccgucauccccucaugcauccccggagaauccuccgacaacugcaccgcccuaguacaaacagaagacaacccccgcgucgcacaaguuuccaucaccaaaugcuccucagacaugaauggcuacugccuccacggacaaugcauauaccuagucgacaugucccaaaacuacugccgcugugaagucggauacacaggcguccgcugcgaacacuucuuccucaccguccaccaaccccuauccaaagaauacgucgcccucaccgucauccucauaauccuauuccucaucacaguugucggcuccaccuacuacuucugccgcugguaccgcaauagaaaauccaaagaaccaaaaaaagaauacgaacgcguaaccucaggcgaccccgaacucccacaagucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7004 - RNA, 744 nt, Artificial Sequence
  mRNA product Design5 comprising derived and/or modified sequence from Homo sapiens__NP_000791.1__HsFGF1 (opt8)
gggagagucccgcagucggcguccagcggcucugcuuguucgugugugugucguugcaggccuuauucaagcuuaccauggcagaaggcgaaauaaccacauucaccgcccucaccgaaaaauucaaccuccccccaggcaacuacaaaaaaccaaaacuccuauacugcuccaacggcggacacuuccuccgcauccuccccgacggcacagucgacggaaccagagaccgcucagaccaacacauccaacuccaacucuccgccgaaucagucggagaaguauacaucaaaagcaccgaaaccggacaauaccuagccauggacaccgacggcuuacucuacggcucacaaacccccaacgaagaaugccucuuccucgaacgccucgaagaaaaccacuacaacacauacaucuccaaaaaacacgcagaaaaaaacugguucgucggccucaaaaaaaacggcuccugcaaacgcggcccccgcacccacuacggccaaaaagccauacucuuccucccccuccccgucucaucagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7005 - RNA, 1143 nt, Artificial Sequence
  mRNA product Design5 comprising derived and/or modified sequence from Homo sapiens__NP_001997.5__HsFGF2 (opt8)
gggagagucccgcagucggcguccagcggcucugcuuguucgugugugugucguugcaggccuuauucaagcuuaccaugguggggguagggggaggggauguggaggauguaacgccgaggccagggggaugccaaauaaguggaagaggggccaggggauguaacgggaucccgggagcggcagcgugggaggcagcgcugccgagaaggagaccgagaaggcacccgagugugaacccgaggagcagggcggcagggagcccgagaacaagagggagaaggacagaggaaagaccaucggggagcagguugggggaucgagggcgaggaagggcgcugccgggagggagauugggagggagagggagggggagagcgccagagagggugggaggaagggggagaggaagagggacggcggcaccgagggcggcgccggcggcaaggggaagcagaccagggccggcgggaacgauggcggcggggagcauaacgacgcuaccagcauugcccgaagacggaggaucgggcgcauucccgccagggcauuuuaaagauccgaagaggcuguacuguaaaaauggaggguucuuucugagaauacauccggauggacggguagauggagugagagagaagagugacccgcacauaaaguugcaacugcaagcggaagagagaggaguagugagcauaaaagggguaugugccaacagauaucuagcaaugaaggaagauggaaggcuacuggcaagcaaguguguaacggacgagugcuuuuucuucgaaaggcuagagaguaacaacuauaacacguacagaagcaggaaauauacaaguugguauguggcgcuaaagaggacgggacaauacaagcuggggagcaagacagggccggggcaaaaggcaauacuguuuuuaccaaugagugcgaagaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7006 - RNA, 861 nt, Artificial Sequence
  mRNA product Design5 comprising derived and/or modified sequence from Homo sapiens__NP_002000.1__HsFGF7 (opt8)
gggagagucccgcagucggcguccagcggcucugcuuguucgugugugugucguugcaggccuuauucaagcuuaccaugcacaaauggauccuaaccuggauccuacccacccuucucuaccgauccugcuuccacaucaucugccuaguaggaaccaucucacucgcaugcaacgacaugacacccgaacaaauggccaccaacgucaacugcuccuccccagaacgccacacacgcagcuacgacuacauggaaggcggagacauccgcguccgccgccucuucugccgaacacaaugguaccuccgcaucgacaaacgcggcaaaguaaaaggcacacaagaaaugaaaaacaacuacaacaucauggaaauacgcacaguagccgucggaaucguagcaaucaaaggcgucgaauccgaauucuaccucgccaugaacaaagaaggcaaacuauacgccaaaaaagaaugcaacgaagacugcaacuucaaagaacucauccuagaaaaccacuacaacacauacgcaucagccaaauggacccacaacggaggcgaaauguucgucgcccucaaccaaaaaggcauccccgucagaggcaaaaaaaccaaaaaagaacaaaaaacagcacacuuccuccccauggccaucaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7007 - RNA, 903 nt, Artificial Sequence
  mRNA product Design5 comprising derived and/or modified sequence from Homo sapiens__NP_001936.1__HsHBEGF (opt8)
gggagagucccgcagucggcguccagcggcucugcuuguucgugugugugucguugcaggccuuauucaagcuuaccaugaaacuacuccccuccgucguccuuaaacucuuccucgccgccguacucuccgcacucgucacaggcgaaucacucgaacgacuccgccgaggccucgccgcaggcaccucaaaccccgaccccccaaccguguccacagaccaacuacuaccacucggcggaggacgcgaccgcaaaguccgcgaccuccaagaagcagaccuagaccuccuccgagucacccucuccuccaaaccccaagcccuagccacccccaacaaagaagaacacggcaagcgaaaaaaaaaaggcaaaggccuaggcaaaaaacgcgacccaugccuacgcaaauacaaagacuucugcauccacggcgaaugcaaauacguaaaagaacuccgagccccaucaugcaucugccaccccggcuaccacggagaacgcugccacggccuaucccuacccgucgaaaaccgccucuacaccuacgaccacacaacaauccucgccgucgucgcagucguccucucauccguaugccuccucgucaucgucggccuacucauguuccgcuaccaccgacgaggcggcuacgacgucgaaaacgaagaaaaagucaaacucggaaugacaaacucccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7008 - RNA, 2463 nt, Artificial Sequence
  mRNA product Design5 comprising derived and/or modified sequence from Homo sapiens__NP_000592.3__HsHGF (opt8)
gggagagucccgcagucggcguccagcggcucugcuuguucgugugugugucguugcaggccuuauucaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7009 - RNA, 2202 nt, Artificial Sequence
  mRNA product Design5 comprising derived and/or modified sequence from Homo sapiens__NP_005336.3 __HsHSPA1A (opt8)
gggagagucccgcagucggcguccagcggcucugcuuguucgugugugugucguugcaggccuuauucaagcuuaccauggccaaagccgccgcaaucggcauagaccucgguacgacguacagcugcguaggcgucuuccaacacggcaagguggaaauaaucgcuaacgaccaaggcaacagaaccacaccgucguacgucgcauucaccgacaccgaacgacucaucggggacgcggccaaaaaccaagucgcacuaaacccccaaaacacaguguucgacgccaaacgacucaucgggagaaaauucggcgaccccguaguccaguccgacaugaaacacuggcccuuccaaguaaucaacgacggagauaaacccaaaguacaagucagcuacaaaggagagaccaaggccuucuacccagaggaaaucucaagcauggugcugacaaaaaugaaagaaaucgcagaagccuaccuaggauacccagucacgaacgccgucaucaccguccccgcauacuucaacgacagccaaagacaggccaccaaagacgccggagucaucgcaggacucaauguccuacgaauaauaaacgagccaaccgcagccgccauagcauacggacucgaccgaacaggcaaaggagaacgcaacguccuaaucuucgaccucgggggcgggaccuucgacgucuccauccuaacaauagaugacggcaucuucgaagugaaagccaccgccggcgacacacaccucgggggagaagacuucgacaaccgccucguaaaccacuucgucgaagaauuuaagcgaaaacacaagaaagacaucagccaaaauaagcgcgcggugcgacgccugagaaccgcaugcgagcgagccaaacgaacgcucucauccucaacccaagcgucacucgaaaucgacucacucuucgagggaaucgacuucuacaccucaaucacgcgagcccgcuucgaagaauuaugcucagaccucuuccgaucaacacuagaacccgucgaaaaagcccucagagaugcaaaacuggacaaagcacaaauccaugaccuuguccuaguaggaggcucaaccaggauccccaaaguacaaaaacugcuccaagacuucuucaaugggcgagaccucaacaaguccauaaaccccgacgaagcagucgcauacggggcagcaguccaagcagcaauauuaaugggcgacaagucggaaaacguccaagaccuccuacuacuagacgucgcgccacuaagucuagggcucgaaaccgcgggaggcgucaugacugcccuaaucaaacgcaacuccaccauccccacaaaacaaacccaaauauucaccacauacuccgacaaccaaccaggaguacugauacaaguauacgaaggcgaacgagccaugaccaaagacaacaaccuacuaggacgcuucgaacucagcggaaucccacccgcccccagaggaguaccccaaauagaagucacauucgacaucgacgcaaacggcauccuaaacguuacagcgaccgacaaauccaccggaaaagcaaacaagauaacgaucacaaacgacaaaggcagacucuccaaagaggagaucgagagaaugguccaagaagcagagaaauacaaagcagaagacgaaguccaacgugaacgcgucagcgccaagaacgcacucgagucguacgccuucaacaugaaaagcgccgucgaggacgaaggacucaaggggaaaaucucagaagccgacaaaaagaaaguacucgacaaaugccaagaaguaaucagcuggcuagaugccaacacacucgccgaaaaagacgaguucgaacacaaacgcaaagaauuagaacaagucuguaaccccaucaucuccggacucuaccaaggcgcaggcggaccaggccccggcggcuuuggcgcacaaggccccaaaggcggcagcgguuccggccccacaauagaagaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7010 - RNA, 2202 nt, Artificial Sequence
  mRNA product Design5 comprising derived and/or modified sequence from Homo sapiens__NP_005337.2 __HsHSPA1B (opt8)
gggagagucccgcagucggcguccagcggcucugcuuguucgugugugugucguugcaggccuuauucaagcuuaccauggcaaaagcggcagcaaucggaaucgacuuaggcaccaccuacucgugcgugggagucuuccaacacggcaagguggaaaucaucgcaaacgaccagggcaaccgcaccacccccagcuacguagccuucacagacaccgaacgccugauaggagacgcagcgaaaaaccaggucgcacucaacccacaaaacacagucuuugacgcaaaacggcucauaggaagaaaauucggcgacccggugguccagagcgacaugaaacacuggcccuuccaggugauuaacgacggagacaagccgaaaguccaagucucguacaaaggcgaaaccaaggcauucuacccggaagaaaucuccuccaugguccuaaccaaaaugaaagaaauagccgaagcauaccucggcuaccccgucaccaacgcgguaauaaccguccccgcauacuuuaacgacagucaacgucaggccaccaaagacgcaggggucauagcagggcucaacguccuccgaaucaucaacgaacccaccgcagcagccauagcauacggucucgaccgcacaggcaaaggcgaacgaaacguccuaaucuucgaccuaggugggggcaccuucgacgucucaauccuaacaauagacgacggcauauucgaaguaaaggcaaccgcaggcgacacccaccuaggcggcgaagacuucgauaaccggcucgugaaccacuucgucgaagaguucaaacgcaagcacaagaaagacauaucgcaaaacaaacgagcaguaaggcgacuccgaaccgcgugcgaacgagcaaaaagaacccuaagcucgagcacgcaggccagccucgaaauagacucccucuucgaagggaucgacuucuacacaucaauaacacgagcacgauucgaagaacucugcagcgaucuauuucgcucaacccucgagccggucgaaaaagcccuccgcgacgcgaaacuagacaaagcccagauacacgaccuaguccuaguagggggaucaaccaggauaccaaaaguacaaaaacuacuccaagacuucuucaacgggcgcgaccugaacaaaucuaucaacccagacgaagccgucgcguacggcgccgcuguccaagccgcaauucugaugggagacaaaagugaaaacguacaagaucuccugcuacuagacguagccccacuaucacugggauuagaaaccgcgggcggagucaugaccgcccuaauaaaaagaaacucaacaaucccaacgaaacaaacacaaaucuucaccaccuacagcgacaaccaacccggagugcucauccaaguguacgaaggcgaacgcgcaaugacaaaagacaacaaccuccuaggaagauucgaacuauccggcaucccaccagccccacgcggagucccacagauagaagucacauuugacauagacgcgaacggaauacuaaacguaacagcgaccgacaaaucgacgggcaaggcaaauaaaauaaccaucacgaaugacaaagggcgccuaagcaaggaagagaucgaaagaauggugcaggaagccgaaaaguacaaggccgaggacgaaguccaaagagaacgggucagcgccaaaaacgcacuagaaucguacgccuucaacaugaaauccgcggucgaagacgaaggacucaaaggaaaaauaagcgaagcugacaaaaagaaaguacucgacaaaugccaagaaguaaucuccuggcucgacgcaaacacauuagccgagaaggacgaguucgaacacaaacgaaaagaacuugaacaaguaugcaaccccauuauuucaggccuauaccaaggagcaggagggcccgggcccggaggcuucggcgcgcaaggcccaaaaggaggauccggaagcggaccgacaaucgaagaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7011 - RNA, 2202 nt, Artificial Sequence
  mRNA product Design5 comprising derived and/or modified sequence from Homo sapiens__NP_005518.3 __HsHSPA1L (opt8)
gggagagucccgcagucggcguccagcggcucugcuuguucgugugugugucguugcaggccuuauucaagcuuaccauggcaaccgccaagggcaucgccaucgggauagaccucggaacaaccuacucaugcgucggagucuuccaacacggcaaaguggagauaaucgccaacgaccaaggaaaccgaacgacacccucauacguggcguucacagauacagagcgguuaaucggcgacgcagccaaaaaccaagucgccaugaacccacaaaacacggucuuugacgccaaaaggcuaauuggcagaaaauucaacgaccccguaguccaggccgacaugaaacucuggcccuuccaagucauaaacgaaggcggcaaacccaaaguccuagucucauacaaaggcgaaaacaaagcauucuacccggaagaaaucucgagcauggucuuaacaaaauuaaaagaaacggccgaagcauuccuuggacaccccgucacgaacgcaguaaucacaguccccgcauacuucaacgacucccaacgccaggcgacaaaagacgccggggucauagccggccuaaacguucugaggauaaucaacgagccgaccgccgcagccauagcguacggacuugacaaaggaggacaaggcgaacgccacguacucaucuucgaccugggcggcggcaccuuugacgucuccaucuuaaccaucgacgacggcaucuucgaaguaaaagccacggccggagacacacaccuuggcggagaagacuucgacaaccggcucgucagucacuuugucgaagaguucaagcgcaaacacaagaaagauaucucgcaaaacaaaagagcaguccgaagacuccgcaccgccugcgaacgcgccaagagaacacucagcagcucaacacaggcaaaccuggaaaucgacucacucuacgaaggcauagacuucuacaccucaauaacacgagcgcgcuucgaagaacuaugcgccgaccucuucagagggacccuggaaccggucgaaaaagcccuccgagacgccaaaauggacaaagcaaaaauccacgacauaguccuaguaggugggucaacccgaauccccaaagugcaacgacuccuccaagacuacuucaacgggcgcgaccucaauaaaucaaucaaccccgacgaagcaguagcauacggcgcagcaguccaagcagcgauccuaaugggggacaagagcgaaaaaguccaggaucuccuccuccuugacgucgcaccucuaucucuaggacuagaaaccgcaggggguguaaugacagcacucaucaaaagaaacucaacaauacccaccaaacaaacacaaaucuucacaaccuacuccgacaaccaaccaggaguacuaauacaagucuacgaaggggaacgcgccaugaccaaagacaacaaccuccugggccguuucgaccuaaccgguaucccaccagcaccacgcggaguaccgcaaauagaagugacguucgacauagacgcaaacggaauccucaacgucaccgcgaccgacaaaucaaccggcaaagugaacaaaaucaccaucacaaacgacaaagggcgauuaagcaaagaagaaaucgaacgaaugguccucgacgcagaaaaauauaaggccgaagacgaaguccaacgagagaaaauagccgccaaaaacgcauuagaaucauacgccuucaauaugaaaagcguaguaucagacgaaggccuaaaaggcaaaaucagcgagagcgacaaaaacaagauacuagacaaaugcaacgaacuccuaagcuggcucgagguaaaccaacucgcagaaaaggacgaguucgaccacaaaagaaaagaacuagagcaaauguguaacccaaucauaacaaaauuauaccaaggaggcugcacggggcccgccugcggaacaggcuaugucccaggaagacccgccaccggccccacgauagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7012 - RNA, 2196 nt, Artificial Sequence
  mRNA product Design5 comprising derived and/or modified sequence from Homo sapiens__NP_068814.2 __HsHSPA2 (opt8)
gggagagucccgcagucggcguccagcggcucugcuuguucgugugugugucguugcaggccuuauucaagcuuaccaugagcgcccggggacccgcaaucggcaucgaccuaggaaccacauacagcugcguaggcguguuccaacacggaaaagucgagauaaucgccaacgaccaaggaaaccgaaccaccccaucauacguagcguucaccgacaccgaaagacucaucggggaugcagcgaagaaccagguggcuaugaaccccacaaacacaaucuucgacgccaaacgccuaauagggagaaaauucgaagacgcaacaguccaaucagacaugaaacacuggcccuucagggucgucucagaaggaggaaaacccaaaguacaagucgaauacaaaggcgaaacaaaaacguucuucccagaagagaucucauccaugguccucacaaagaugaaggaaauagccgaagccuaccuaggcggcaaaguccacagcgcagucauaaccguaccagcauacuucaacgacagccaacggcaagccacaaaagacgcaggaaccaucaccggguuaaacguacuacgaauaauaaacgaacccacagcagcagccaucgcguacggccucgacaagaaaggcugcgccggaggcgagaaaaacguacucaucuucgaccucggcggaggcacauucgacguaucgauacucacaauagaagacggcauauucgaagucaaaucaaccgccggagauacacaccuuggaggggaggacuucgacaacagaauggugagccaccuagcagaggaguucaaacgaaaacacaagaaagacauaggacccaacaaaagggccguacgcagacucagaacagcaugcgaaagagccaaacgaacacuaucauccuccacacaggccagcauagaaauagacucacuauacgaaggagucgacuucuacaccagcaucacacgcgccagauucgaagaacucaacgccgaccuauuccgaggcacccucgagccggucgagaaagcgcuccgagacgcaaaacucgacaaaggacaaauacaagaaauaguccucgucggaggcuccacccgaaucccuaaaauacaaaaacuacuccaagacuucuucaacggaaaagaacuaaacaaaucaaucaaccccgaugaagccguugcauacggcgccgcuguccaagcagcaauccuaauaggagauaaaagcgaaaacguacaagaccuccugcuacuagacgucaccccacucucacucggaaucgagaccgccggcgguguaaugaccccacucauaaaacgaaacaccaccauccccaccaaacaaacacagacguucaccaccuacuccgacaaccaaucauccgugcuagugcaagucuacgaaggcgaaagagccaugaccaaagacaacaaucuccucggcaaauucgaccugacgggcauacccccagccccacgaggcgucccccaaaucgaggucaccuucgacauagacgcgaacggcauccucaacgucacugcugcagacaaaucgacaggaaaggaaaacaaaaucaccaucacaaacgacaaggggcgccucagcaaagacgacaucgaccgaaugguacaagaagcagaacgcuacaagagcgaagacgaagccaacagagaccgcgucgccgccaaaaacgcccucgaauccuacacauacaacauaaaacaaaccgucgaagacgaaaaacuacgcggaaaaauaagcgagcaagacaaaaacaaaauauuagacaaaugccaagaaguaaucaacuggcucgaccgcaaccaaauggccgaaaaagacgaauacgaacacaaacaaaaagaacucgaacgaguaugcaacccgauaaucaguaagcuguaucaaggaggcccaggaggcggaagcggcggcggagguucgggcgcguccggaggcccaacaauagaagaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7013 - RNA, 2799 nt, Artificial Sequence
  mRNA product Design5 comprising derived and/or modified sequence from Homo sapiens__NP_002145.3 __HsHSPA4 (opt8)
gggagagucccgcagucggcguccagcggcucugcuuguucgugugugugucguugcaggccuuauucaagcuuaccaugagcgugguaggcauagaccugggcuuccagagcuguuaugucgcaguagcccgcgcaggcggcauagaaacaaucgcaaacgaguacagcgaccgcugcacaccggcaugcaucucguucggacccaaaaaccguagcaucggcgcggcagcgaaaagccaggucauaagcaaugcgaaaaacacaguccagggauucaaacgcuuccacggccgagcauucuccgacccauucgucgaagcagagaaaagcaaccuggcauacgacaucguccaguuaccgaccggccuaaccgggaucaaagucaccuacauggaagaggaacgcaacuucaccacagaacaagucaccgccaugcugcuaagcaaacugaaagagacugcagaguccguacucaagaaaccagugguggacugugucguaagcgugccgugcuucuacacggacgccgaacgacguagcgugauggacgcaacacaaauagcgggacugaacugucuccgccuaaugaaugaaacgacagcaguagcccucgcuuacggaauauacaaacaagaccuacccgcgcucgaagagaaaccccgcaacgucgucuucguggacaugggacacucggccuaccaagucuccgucugcgccuucaaccggggcaaacugaaaguccucgccaccgcauucgacaccacacuuggaggccgaaaauucgacgaaguucucgucaaccacuucugcgaagaguucgggaagaaauacaaacuugacauaaaauccaaaauccgagcacugcuccgacucagucaagaaugcgaaaaacuaaagaagcucauguccgcgaacgccagcgaccucccccuauccaucgaaugcuuuaugaacgacgucgacgucuccggaaccaugaaccgagggaaauuccuagaaaugugcaacgacuuacuagcgagaguagaaccaccccuacgaagcguacuagaacagaccaaauuaaagaaagaagauaucuacgcaguagaaauagugggcggagcaacccgcauacccgccguaaaagagaaaaucucaaaauucuuuggcaaagaacucucgacaacacuaaacgccgacgaagcagugacccgcgggugcgccuugcaaugcgcaauucucagccccgcuuucaaaguaagagaauuuucaauaacagacgucguaccauaccccauaucacuccgcuggaacuccccagcagaagaaggaagcuccgacugcgaagucuucuccaaaaaccacgcagcccccuucucuaaaguccucaccuucuaccggaaagaacccuucacccuagaagccuacuacucgucaccacaggaccuaccauaucccgaccccgcaaucgcgcaauucuccguccaaaaaguaacaccccagagcgacgggagcagcagcaaaguuaaaguaaaaguacguguaaacguacacggaaucuucucagucuccucagccucccucgucgaaguccacaaaagcgaagaaaacgaagaaccaauggaaaccgaccagaaugcaaaagaagaagagaaaaugcaagucgaccaagaagaaccccacgucgaggagcaacaacaacaaacuccagccgaaaacaaggccgaaucagaagaaauggagaccucacaagccgggucaaaagacaagaaaauggaucaaccgccccaagcgaagaaagcgaaagucaaaacauccacagucgaccuccccauagagaaccaacugcucuggcaaaucgaccgcgagaugcucaaccucuacaucgagaacgaaggaaaaaugaucaugcaggacaaacuagaaaaagaaaggaacgacgccaaaaacgccguggaagaguacgucuaugaaaugcgcgacaaauuaagcggagaguacgagaaauuugucuccgaagacgacagaaacuccuucacacuuaaacucgaagacaccgaaaacuggcuauacgaagacggcgaggaccagcccaaacaaguauacguggacaaacucgcagagcugaaaaaccuaggacaacccaucaaaauccgauuucaagaaagcgaagaacgccccaagcuguucgaggaacucggaaaacaaauccaacaauacaugaaaaucauaucauccuucaaaaacaaagaggaccaauacgaccaccucgacgccgcagauaugacgaaaguagaaaaguccaccaacgaagcgauggaauggaugaacaacaaacucaaccuacaaaacaaacaaucgcucacaauggaucccgugguaaagagcaaggagaucgaggcaaaaauuaaagaacucacauccacaugcagccccauaaucucaaaacccaaaccaaaggucgaaccgccaaaagaagaacagaagaacgccgagcaaaacggcccaguagacggccaaggcgacaacccaggcccccaagcagcggaacagggaaccgacacggccguccccucagauucggacaagaaacucccagaaauggacaucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7014 - RNA, 2796 nt, Artificial Sequence
  mRNA product Design5 comprising derived and/or modified sequence from Homo sapiens__NP_055093.2 __HsHSPA4L (opt8)
gggagagucccgcagucggcguccagcggcucugcuuguucgugugugugucguugcaggccuuauucaagcuuaccaugucaguggucggcaucgaccuaggcuuccucaacugcuacaucgccgucgcccgcuccggcgggauugaaacaaucgcaaacgaguacucggacaggugcacacccgcuugcauaucacugggaucgcggacgcgcgccauaggaaacgcagccaaaagccagaucguaacaaacgugcgcaacaccauccauggcuuuaaaaagcuccacggcaggagcuucgacgaccccaucguucaaaccgagcgcaucagacuaccauacgaauuacagaaaaugcccaacggcagcgccgggguaaaaguccgcuaccucgaagaagaacgaccuuucgcgaucgaacaaguuaccggaauguuacuagcaaaacugaaggaaaccucagagaacgcccucaagaaacccguggcagacugcguaauaucaaucccuagcuucuucacagacgcagaaagacguucaguaauggcggcagcccaaguagcagggcucaacugccuccgacuaaugaacgaaacaacagccguggcccucgccuacggcauauacaaacaagaccugccgccacuagacgaaaagccccgcaacgucguguucauagacaugggacacagcgccuaccaaguccucgucugcgccuuuaacaagggcaaacucaaaguccucgccacgacauucgaccccuaccugggcggacgcaauuucgacgaagcucucguagacuacuucugcgacgaguucaaaacaaaauacaaaaucaacgucaaggaaaacucaagagcccugcuccgacuauaucaagaaugcgagaaacuaaagaaacucauguccgcgaacgccagcgaccucccacuaaacaucgaauguuuuaugaacgaccuggacgucagcuccaaaaugaaccgcgcccaguucgaacaacucugcgccagccuacuagcacgcguggagccaccccucaaagccguaauggaacaagcgaaccuccagcgcgaggacauaucaagcaucgagauaguaggcggcgcgacgcgcauccccgccguaaaagagcaaaucacaaaauucuuccucaaagacauuucaacaacacuuaaugcagacgaagcaguagccaggggaugcgcucuacaaugcgccauccucagcccggcauucaaaguacgcgaguucuccaucacagaccuaguccccuacucaaucacacucagauggaaaaccucauucgaagacgggagcggagaaugcgaaguauucugcaaaaaccacccugccccauucagcaaagugauaacguuccacaagaaagaacccuucgaacuugaagcguucuacacaaaccuucacgaaguccccuacccugaugcgcgaaucgguucauucacaauacagaacguauucccccaaagcgacggcgacucgagcaaaguaaaagucaaaguccgcguaaacauccacggcaucuucucaguagcaagugccagcgugaucgaaaaacaaaaccucgaaggcgaccacagcgacgcccccauggagacagaaacaucguucaaaaacgaaaacaaagacaacauggacaaaaugcagguagaccaagaagaaggccaccagaagugccacgccgaacacacacccgaagaagaaaucgaccacaccggcgccaaaacaaaaucggcagucuccgacaaacaagaccggcuaaaccaaacccucaagaaaggcaaaguaaaaucaaucgaccuacccauacaguccucacucugccgccaacugggccaagaucuccuaaacucauacaucgaaaacgaaggaaaaaugauaaugcaagacaaacucgaaaaagaacggaacgacgccaaaaacgcgguagaggaguacgucuacgacuuucgggaccgacugggcacgguuuacgaaaaauucaucacacccgaagaccuaagcaagcuaucugcgguccuggaagauaccgagaacuggcucuacgaagacggcgaagaccaaccaaaacaaguguacguagacaagcugcaggaacugaagaaauaugggcaaccaauccaaaugaaauacauggaacacgaagaaaggcccaaagcacugaacgaccuaggcaagaaaauucaauuagucaugaaagugaucgaagcguacagaaacaaagacgaaagauacgaccaccucgacccuacagagauggagaaaguagagaagugcauaucagacgccauguccuggcuaaacagcaagaugaacgcccaaaacaaacucagccuuacgcaagaccccguggucaaagucucagaaauaguugcgaaaucaaaggagcuagauaacuucugcaaccccauaauauacaaaccgaagcccaaagccgaaguccccgaagacaagcccaaagccaacagugaacauaacgggccgauggacggacagucaggcacugagaccaaaagcgacucgacaaaagacagcagucaacacacaaagucguccggagagauggaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7015 - RNA, 2241 nt, Artificial Sequence
  mRNA product Design5 comprising derived and/or modified sequence from Homo sapiens__NP_005338.1__HsHSPA5 (opt8)
gggagagucccgcagucggcguccagcggcucugcuuguucgugugugugucguugcaggccuuauucaagcuuaccaugaaacucagccuagucgcagccaugcugcugcuccucagcgcagcacgggcagaagaggaagacaagaaagaagacgugggaacaguaguaggcauagaccucggaacgacauacagcugcguagggguauucaaaaacggacgagucgagaucauagccaacgaccagggcaacagaauaaccccaaguuacguagcguucacacccgagggugaacgacugaucggagacgcagcgaaaaaccaacucacaagcaaccccgaaaacacaguauucgacgcaaagcgacuaauaggccgcaccuggaacgaccccucgguccagcaagacaucaaauuccugccauucaaagucgucgagaagaaaacaaaacccuacauacaaguagacauagggggcgggcagacgaaaacguucgcgccagaagaaauaagcgcaaugguacugacgaaaaugaaagagaccgcagaagcguaccugggcaagaaagucacccacgcagucguaacagugccagccuacuucaaugacgcgcaacgacaagcaacaaaggacgcaggaacaaucgcgggacugaacgugaugcgaaucauaaaugaacccaccgccgccgcaauagcguacggacuagacaaacgggaaggcgagaaaaacauccuagucuucgaccugggcggagguaccuucgacguaagucuccugacaaucgacaacggcguauucgaagucguagcaacaaacggggacacacaccugggaggagaagacuucgaccagcgaguaauggagcacuucauaaaacuauacaagaagaaaaccggaaaagacguaaggaaagacaacagagccguacaaaaacucaggcgggaggucgaaaaagccaaacgcgcccuauccagccaacaccaagcgcgcaucgaaauagaaucauucuacgagggggaagacuucagcgaaacccuaacacgcgcaaaauucgaagaacugaacauggaccuauuccgcagcacgaugaaaccaguacaaaaaguccuagaggacagcgaccuaaagaaaagcgacauagacgaaauaguauuagugggcggcucgaccaggauaccaaaaauacaacaacugguaaaagaguucuucaacggcaaagaaccaucgcgagggaucaacccagacgaagccgucgcauacggagccgcaguucaagcaggaguacugagcggcgaccaagacacaggagaccucguacuacuggacgugugcccacucacccuaggcauagaaacaguaggcgggguaaugacaaaacucauaccaagaaacacggucgugcccaccaagaaaagccagauauucagcacggcaagcgacaaccaacccaccguaacgaucaaagucuaugaaggagaacgaccccucacaaaagauaaccaccuacugggcaccuucgaucuaacaggcauaccaccagccccaagagggguaccacaaauagaagugacauuugaaaucgacguaaacgggauucuccgagugaccgcggaagacaaaggaaccggaaacaaaaacaaaauaacgauaaccaacgaccaaaacagacucacaccggaagaaaucgaaagaauggucaacgacgcagagaaauuugccgaagaggacaagaaauugaaagagcgaauagacaccagaaacgaacucgaaagcuacgccuacucacucaaaaaccagauaggugacaaagaaaaacuaggagggaaacuaagcagugaagacaaagaaaccauggaaaaagccgucgaagagaaaaucgaauggcuagaaucacaccaagacgcagacauagaagacuucaaagccaaaaagaaagaacuagaagaaauaguacaaccaaucauauccaaacuauacggaagcgcagggcccccacccacaggagaagaggacacagcggaaaaagacgaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7016 - RNA, 2208 nt, Artificial Sequence
  mRNA product Design5 comprising derived and/or modified sequence from Homo sapiens__NP_002146.2__HsHSPA6 (opt8)
gggagagucccgcagucggcguccagcggcucugcuuguucgugugugugucguugcaggccuuauucaagcuuaccaugcaagcaccccgggagcucgcagucggcauugaucucggaacaacauacuccugcguaggaguguuccagcaagggcgcguggaaauacucgcaaacgaccaaggcaaccggaccaccccaagcuacguggccuucaccgacacagagcggcugguaggagacgcagcaaaaagccaagccgcgcugaauccccacaacacagucuucgacgcaaaaaggcuaauuggaagaaaauucgcagacacaacaguacaaagcgacaugaaacauuggcccuuccgagucgucucagaagggggcaaacccaaggucagagucugcuacagaggugaagacaaaacauucuaccccgaagagauaucaagcauggugcucagcaaaaugaaagagacggccgaggcauaccucgggcaaccggucaaacacgcgguaauaacagucccagcauacuucaacgauagccaacgccaagccacaaaagacgccggagcaaucgccgggcucaacguccuacgaauaaucaacgaaccaacagcggcagcaaucgcuuacgggcuagacagaagaggcgcaggcgaacggaacguccugauauucgaccuaggaggaggaacauucgacguaucagugcuaagcaucgacgcaggaguauucgaagucaaagccacggcaggagacacacaccugggcggggaagacuucgacaacaggcuaguaaaccacuucauggaagaguuccggcgcaaacacgggaaagaccuaucagggaacaaaagagcccugcgaaggcugagaacagccugcgaacgcgcaaaaaggacacuaagcagcuccacacaagcaacacuagaaauagacucccucuucgaaggagucgacuucuauaccucgaucacgcgcgcacgauucgaagaacuaugcagcgaccucuuccgaucgacccuggaaccgguagaaaaagcccuaagagacgcgaagcuagacaaggcccaaauacacgacguaguccucguaggaggaucgacacgcaucccaaaaguacaaaaacuccuacaagacuucuucaacgggaaagaacucaacaagucaauaaaccccgacgaagcaguggccuacggugccgcaguucaggccgcaguccugaugggcgacaagugcgaaaagguucaagaccuacuacuccuagacguggcaccccucucccucggacuagagacagcgggcggagucaugacuacacuaauccaaagaaacgcaaccaucccaacaaagcaaacacaaacauucacaaccuacucagacaaccaaccaggcguauucauccaagucuacgagggcgaacgcgcaaugaccaaagauaacaaccuacugggccgauucgagcucucaggcauacccccagcaccccgaggagucccacaaauagaaguuacauucgacaucgacgccaacgggauauugagcgugaccgcaacagaccgcucaaccggaaaggcaaacaaaauaacaauaacaaacgauaaaggacgacuaagcaaagaagaaguggagcgcaugguacacgaggcggaacaauacaaggccgaggacgaagcccaacgggacagaguagccgccaaaaacagccuggaagcgcacgucuuccacgucaaaggaucacuacaggaagaaucccuccgagacaaaauacccgaggaagacagacgaaaaaugcaagacaagugccgagaaguccuagccuggcucgaacacaaccaacuggccgaaaaagaagaauacgaacaccaaaagcgagaacuagagcaaauaugcagaccaauauucucgagacuauacggcgggccgggcguaccuggcggaucgagcugcggcacccaagcccgacaaggcgacccaucaaccgggccuauaaucgaggaaguggacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7017 - RNA, 1380 nt, Artificial Sequence
  mRNA product Design5 comprising derived and/or modified sequence from Homo sapiens__P48741__HsHSPA7 (opt8)
gggagagucccgcagucggcguccagcggcucugcuuguucgugugugugucguugcaggccuuauucaagcuuaccaugcaagcaccacgcgaacucgcagucggaaucgaccuaggcaccacauacucaugcgucggcguauuccaacaaggaagagucgaaauccucgccaacgaccaaggaaaccgaaccacgccaagcuacgucgcauucacagacacagaacgccuggucggcgacgcagccaaaagccaagccgcacucaacccacacaacacaguauucgacgcaaaacggcucauaggccgcaaauucgccgacaccaccguccaaagcgacaugaaacauuggccauuccaagucguaagcgaaggcggcaaacccaaaguccgagucugcuacagaggcgaggacaaaacauucuacccagaagaaaucuccagcaugguacuaaguaaaaugaaagaaaccgcagaagcauaccuaggccaacccguaaaacacgcaguaauaaccguaccaaccuacuucucaaacagccaacgccaagcaacaaaagacgcaggagccaucgccggccucaaaguccucccaauaauaaacgaagcaaccgcagccgcaaucgccuacggacucgaccgacgaggcgccggcaaacgaaacguacucauauucgaccucggcggcggcaccuucgacguaagcguacuaagcaucgacgcaggagucuucgaagucaaagcaacggccggcgacacacaccuuggaggagaagacuucgacaacagguuagucaaccacuucauggaagaguuccgccgcaaacacggaaaagaccucucaggaaacaaacgcgcacugcgacggcuacgaacagcgugcgaacgcgcaaaacgcacccccuccagcagcacacaagccacucucgaaaucgacucacuguucgaaggcgucgacuucuacaaauccauaacacgcgcacgcuucgaagaacucugcagcgaccucuuccgcagcacccucgaacccguugaaaaagcccuacgcgacgccaaacuagacaaagcccaaauccacgacuucguccugggcggcggccuccacucacacccccaaggagccgaaguagcagcaggacuccugcaacgccaaggagcagaacaagaacaccaacccuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7018 - RNA, 2217 nt, Artificial Sequence
  mRNA product Design5 comprising derived and/or modified sequence from Homo sapiens__NP_006588.1 __HsHSPA8 (opt8)
gggagagucccgcagucggcguccagcggcucugcuuguucgugugugugucguugcaggccuuauucaagcuuaccaugagcaaaggaccagcaguagggauagaccucggaaccacauacuccugcguagggguauuccagcacggcaaaguagaaauaauagcgaacgaccaaggcaaccggaccaccccuuccuacguagccuucaccgacacagagcgccucaucggagacgcggccaaaaaccaagucgcaaugaaccccaccaacacaguauucgacgcaaaaagacucauaggcaggcgguucgacgacgcagucguacaaagcgacaugaagcacuggcccuucauggucguaaacgacgcaggacgcccaaaaguccaaguagaauacaagggcgagacaaaauccuucuacccagaagaggucuccagcaugguacugaccaaaaugaaagagauagcagaagccuaccucggaaaaacuguaaccaacgcaguagucacagucccagccuacuucaaugacagccaacgccaggccaccaaagacgccggaaccaucgccggacuuaacguacuacgcaucaucaaugagccaacggcggccgcaaucgcguacgggcucgacaaaaagguaggagccgaaagaaacguccugaucuucgaccuaggaggaggaacauucgacgucucaauccucacaauagaagacggcauauucgaaguaaagagcacggccggcgacacacaccugggaggagaagacuuugacaacagaaugguaaaccacuucauagcagaguucaagcgcaagcacaagaaggacaucagcgaaaacaaaagagcaguacgccgccuccgcaccgccugugaaagagcaaaacgcacccucagcuccagcacccaagcaaguauagaaauugacucacuauacgaaggcaucgacuucuacaccagcaucacccgagcaagauucgaagaauuaaacgcagaccucuucagaggaacccuggacccagucgagaaagcacuacgagacgcaaaacuagacaaaagucaaauacacgacauaguccuagucggaggcagcacacgaaucccgaagauacagaaacuccuccaagacuucuucaacggaaaagaacuaaacaaaagcauaaauccagacgaagcagucgcauacggcgcagcgguccaagcggccauacuuucaggcgacaaaagcgagaacguacaagaccugcugcuccuggacgucacgccgcucucacuaggcaucgaaacagccggcggcguaaugaccgugcucauaaaacgcaacacaaccauaccaacaaaacagacccagaccuucacgacauacuccgacaaccagccaggcguacucauacaggucuacgaaggagaacgcgcaaugacaaaagacaacaaccuccuaggcaaauucgaacucacagggauacccccagcaccgcgcggagucccacaaauagaagucaccuucgacaucgacgcaaacggaauccuaaacguauccgccguagacaaaucaaccggaaaagaaaacaaaauaacgaucacaaacgacaaaggccgccuaagcaaggaggacaucgagagaaugguccaggaggccgaaaaauacaaagccgaagacgaaaaacaacgcgacaaaguaaguagcaagaacagccuggaaagcuacgcauucaacaugaaggcgacggucgaagacgaaaaacugcagggaaaaauaaacgacgaagacaaacagaaaauccuagacaaaugcaacgaaaucauaaacuggcuggacaaaaaucaaaccgccgaaaaagaagaauuugaacaccaacaaaaggagcucgaaaaagugugcaaucccauaaucaccaaacuauaccaaucagcgggaggaaugcccggagggaugccgggcggguucccaggagggggagcacccccaagcggaggcgcaagcucgggccccacgauagaggaggucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7019 - RNA, 2316 nt, Artificial Sequence
  mRNA product Design5 comprising derived and/or modified sequence from Homo sapiens__NP_004125.3 __HsHSPA9 (opt8)
gggagagucccgcagucggcguccagcggcucugcuuguucgugugugugucguugcaggccuuauucaagcuuaccaugauaucagccagccgcgcggccgccgcaagacuggugggagcagccgcgagccgcggaccaacagcagcgcggcaccaagacagcuggaacggacugucacacgaagcauuccgacucgugaguagaagagacuacgcgagcgaagccauaaaaggggccguagucggaaucgaccucggaacaacaaauaguugcguagccgugauggagggaaaacaagccaaaguacuagagaacgcggagggagcgagaaccacaccaagcgucguagccuucaccgcagauggagaaaggcucguaggcaugcccgcaaaaagacaagcagugacgaacccaaacaacaccuucuacgcgacaaagcgccucaucggccgacgcuacgacgaccccgaggugcaaaaagacaucaaaaacguaccauucaaaauagugagagcaagcaacggcgacgccugggucgaagcccacggcaaacuauauagccccagccagauaggggccuucgucuugaugaaaaugaaagagaccgcagaaaacuaccuaggacacacagccaagaacgcaguaauaaccguaccugcauacuucaacgacagccagagacaagccacaaaggacgccggccagauaagcggacuuaauguacuacgcguaauaaacgaaccgacagccgccgcgcucgcauacggccuagacaaaagcgaggacaaaguaauagcaguauacgaccuaggagggggaacuuucgacaucucgauacuagaaauacaaaagggaguuuucgaggucaagucaacaaacggggacaccuucuuaggcggagaagacuucgaccaagcgcugcuacgccacaucgugaaagaguucaaaagagaaacaggggucgaccucacgaaagacaacauggcacuccaaagagucagagaagcggcagaaaaagcgaaaugcgaacuaagcagcagcguccaaacagacauaaaccuacccuaccuaacaauggauagcucaggcccaaaacaccugaacaugaagcucacgcgcgcgcaauucgaggggauagugacugaccucaucagaagaaccauagcaccaugccaaaaagcaaugcaagaugccgaaguaagcaaaagcgacauaggggaagucauccuagucggaggaaugacgaggaugccaaaaguacaacaaacaguacaagaccucuucgggagagccccguccaaggccguaaacccggacgaggcaguagccauaggagcggccauacaaggaggaguccuagccggggacguaacagacgugcugcugcucgacguaacaccccugucucugggcauugaaacccuaggaggcguuuucacaaaacucaucaacagaaacacgacgauaccgacuaagaaaucccaagucuucuccacagccgccgacggucaaacccaaguagaaaucaaagucugccaaggagagagggaaauggccggggacaacaaauuacucgggcaauucacccucaucggaaucccacccgcgccccgaggcgugccccagauagaggucacauucgacaucgacgccaacggaauaguacacguaagcgccaaagacaaaggaacaggccgggaacaacagauagucauacagucaagcggaggccucagcaaggacgacaucgaaaacauggucaaaaacgcagagaaguacgcagaagaggaccggagaaagaaagaacgcguggaagcaguaaacauggccgaagggauaauacacgacaccgagacaaaaauggaggaguucaaagaccagcugcccgcggaugaauguaauaaacuaaaagaagaaauaagcaaaaugagggaacuacucgcacgaaaggacucugaaacgggcgagaacauuagacaagcggcaagcagccuccaacaagcaucccugaagcucuuugaaauggcauacaagaaaauggcgucggaaagggaaggguccgggagcucaggcacgggagagcaaaaggaagaccaaaaggaggaaaaacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7020 - RNA, 2304 nt, Artificial Sequence
  mRNA product Design5 comprising derived and/or modified sequence from Homo sapiens__NP_079291.2__HsHSPA12A (opt8)
gggagagucccgcagucggcguccagcggcucugcuuguucgugugugugucguugcaggccuuauucaagcuuaccauggcggacaaagaagccggaggaagcgacggcccccgcgaaaccgccccaacauccgccuacagcucgcccgcccgcagccuaggagacaccggaaucacaccccucucucccucccacauugucaacgacaccgacuccaacguaucugaacaacaaucauuccucguaguagucgcaguagacuucggcaccaccucguccggauacgcauacucguucaccaaagaacccgaauguauccacguaaugagacgcugggaaggcggcgaccccggggucuccaaccagaaaaccccaaccaccauacuacucaccccagaaagaaaauuccacuccuucggauacgccgcccgcgacuucuaccacgaccucgaccccaacgaagccaagcaauggcucuacuuggaaaaauucaaaaugaaacuccauacaaccggagaccucaccauggacaccgaccucacagcugcaaacggcaagaaagucaaagcacucgagaucuuugccuacgcgcugcaauacuucaaagaacaagcccucaaagaacucuccgaccaagcagggucagaguucgaaaauagcgacguccgaugggucaucaccgucccagcaauuuggaaacaacccgcaaaacaauucaugcgccaagccgccuaccaagcuggccuagcuucaccagaaaacucagaacaacuaaucauagcacucgaaccggaagcagcaagcaucuacugcagaaaacuacgccuccaccaaaugaucgaacucagcucaaaagccgccgugaacggcuacuccggauccgacaccguaggcgcgggcuucacacaagccaaagaacacauccgucggaaccgccaaucacgaacauuccuagucgaaaacgucauaggcgaaaucuggagcgaacuagaagaaggcgacaaauacgucguagucgacucaggcggaggcacaguggaccucaccguacaucaaauccgccuaccagaaggccaccucaaagaacucuacaaagcuacaggcggaccauacggaucacugggcgucgacuacgaguucgaaaaacuacuauacaagaucuucggcgaagacuuuaucgaacaauucaaaaucaaaagacccgccgccuggguagaccucaugaucgccuucgaauccagaaagagggcagccgcgcccgaccgcacuaacccccugaacauaacacucccauucagcuucaucgacuauuacaagaaauuccgcggccacucaguugaacacgcccuccgcaaauccaacguagacuuuguaaaauggucaucccaaggcaugcuccggaugucccccgacgccaugaacgcccuauucaaaccaaccauagauuccauaaucgaacaccucagagaccucuuccaaaaacccgaagucucaaccguaaaauuccuuuuccuagucgggggauucgccgaagcgcccuuacuacaacaagcggugcaagcugcauucggcgaucaaugccgaauaauaaucccccaagacguaggccuaaccauacugaaaggggcaguacucuucggccucgaccccgcaguaaucaaaguccgacgcuccccacuaaccuacggcguaggcguacucaacagauacguagaaggaaaacauccaccagagaaacuccugguuaaagacggaaccagauggugcaccgacguauucgacaaauucaucagcgccgaccaaucaguugcacucggcgaauuaguuaagcgaagcuacacccccgcgaaaccaucccaacucgucaucgucauaaauaucuacagcucagaacacgacaacgucucguucaucaccgaccccggggucaaaaagugcggcacgcucagacucgaccucaccggcaccagcgggacggcaguaccagcgcgacgcgagauacaaacccucaugcaauucggcgacacagagaucaaagccaccgcgauugacauagcaacaucaaaaucugucaaagucggaaucgacuucuuaaacuacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7021 - RNA, 2337 nt, Artificial Sequence
  mRNA product Design5 comprising derived and/or modified sequence from Homo sapiens__NP_443202.3 __HsHSPA12B (opt8)
gggagagucccgcagucggcguccagcggcucugcuuguucgugugugugucguugcaggccuuauucaagcuuaccaugcucgccguccccgagaugggcuugcagggccuauacauaggcagcucacccgaaagaagcccagucccauccccaccuggaucccccagaacccaagaauccugcggaaucgcuccccucaccccaucacaauccccaaaaccggaaguccgcgcaccccaacaggccucauucucaguuguugucgccauagacuucggcacaaccucaagcggauacgccuucagcuucgccucagaccccgaagccauacauaugaugcgcaaaugggaggguggcgaccccggcgucgcccaccagaaaacgcccacuugccuacuccucaccccagaaggcgccuuccacuccuucggcuacacggccagagacuacuaccacgaccucgaccccgaagaagcaagggacugguuguacuucgaaaaauuuaaaaugaaaauucauagcgccacagaccuaacccuaaaaacgcaauuagaagcuguaaacggcaaaaccaugcccgcccucgaagucuucgcccacgcacuccgcuucuuccgagaacacgcacuccaagaacuaagagagcaaucacccagccuccccgagaaagacacaguacgcuggguacugaccguacccgccauauggaagcaaccagcgaaacaauucaugagagaggccgcauaccucgcagggcuaguaucccgggaaaacgcagaacaacuccucauagcauuagaaccagaagcagccucagucuauugcagaaaacuccgccugcaccaauugcucgaccucagcggccgcgccccaggaggcggucgacucggcgaacgacgaagcauagacucaucauuccgccaagccagagaacagcuccgccgauccagacacucacgaaccuuccuuguagaauccggcgucggagagcuuugggccgaaaugcaagccggggaccgauacgucguagccgacugcggcggcggaaccgucgaccuaacaguacaccaacuagaacaaccacaugguacccucaaagaacucuacaaagccuccggcggucccuacggagccguuggcguagaccucgcauucgaacaacuacucugcagaauauucggagaagacuuuauagcuaccuuuaaaagacaacgacccgcagccugggucgaccuaacuauagccuucgaagcacgcaaacgaacagccggcccacacagagccggcgcacucaacauaagccuaccauucucguucauagacuucuaccgcaagcaaagaggccacaacgucgaaaccgcccucagacgaucauccguaaacuucguaaaauggucaagucaaggaaugcugcgaaugucaugcgaagcaaugaacgagcuauuccaaccgacaguaagcggaaucauccaacacaucgaagcgcuccuagcgcgcccugaaguccaaggcguaaaacuucuauucuuaguuggaggauucgcagaaagcgccguacuucaacaugcaguccaagcagcacucggcgcacgcgggcuccgagucgucgucccccacgacguuggccuaaccauacucaaaggagccguccucuucggacaagccccaggggucguccgagugcgcagaucaccgcuaacauacggcguaggcgugcucaaucgcuucguaccaggcagacacccgcccgaaaaacuccuaguccgagacggacggcgcuggugcaccgacgucuucgaaagauucgucgcggcugaacaauccguagcccucggcgaagagguacgucgcagcuacugcccagcccgacccggacagagacgaguucucaucaaccucuacugcugugcagcagaagacgcccgguucauaacagaccccggcguaagaaaaugcggagcacucucccuugaacuagaaccggcagacugcggacaagacaccgccggcgccccacccggaagacgcgaaaucagagccgcaaugcaauucggagacacagaaaucaaagucacagcaguagacguaagcaccaacagaagcgucagagcaagcauagacuuccucucaaacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7022 - RNA, 1692 nt, Artificial Sequence
  mRNA product Design5 comprising derived and/or modified sequence from Homo sapiens__NP_008879.3__HsHSPA13 (opt8)
gggagagucccgcagucggcguccagcggcucugcuuguucgugugugugucguugcaggccuuauucaagcuuaccauggcccgcgaaaugaccauacuaggcuccgccguauuaacccuccuccuugcaggcuaccuagcacaacaauaccucccacuaccaaccccaaaagucauuggcauugaccucggaaccacguacugcagcgucggcgucuucuucccuggaaccggcaaagucaaaguaauacccgacgaaaacggccacaucuccauaccauccaugguuuccuucaccgacaacgacguguacgucggauacgaauccgucgaacucgccgacagcaacccacagaacaccaucuaugacgcaaaacgauucaucggaaaaauauucacagccgaagaacucgaagccgaaaucggacgcuauccauucaaaguacuaaacaaaaacggcaugguagaguucuccgucacaagcaacgaaaccaucaccgucagccccgaguacguaggaucuagacugcuucuaaaacuaaaagaaauggccgaagccuaucugggcaugcccgucgccaacgcaguaaucucgguccccgcagaguucgaccuaaaacaacgaaacucaaccauagaagcggccaaccuagccggccucaaaauacuaagagucauaaacgaacccacugccgcggcuauggccuacggucuccacaaagccgacgucuuccacguccucgucaucgaccucggcggcggaaccuuagacgucagccuacucaacaaacaaggcggcauguuccucacccgcgcaaugagcggcaacaacaaacucggaggccaagacuucaaccaacgccuacuccaauaccucuacaaacagaucuaccaaaccuacggcuuuguaccaucccgcaaagaagaaauacaccgacuccgacaagccgucgaaauggucaaacucaaccugacccuacaccaaagcgcccagcuaucuguacuacuaaccgucgaagaacaagaccgcaaagaaccccacucaagcgacaccgaacuccccaaggacaaacucagcucugcggacgaccaccgcgucaacuccggcuucggccgaggcuuaucagacaagaaauccggagaaagccaaguccucuucgaaaccgagauaucccgcaaacuauucgacacacucaacgaagaccuauuccagaaaaucuuaguacccauacaacaaguccucaaagaaggccaccuggagaaaacagaaauagacgaagucguccuaguaggcggcagcacacgcaucccccgcauuagacaagucauccaagaguucuucggcaaagaccccaacaccuccgucgaccccgaccuagccgucgugaccgggguagcaauccaagccggcaucgacggaggcuccuggccacuacaggucucggcacuugaaaucccgaacaaacaccuccagaaaaccaacuucaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7023 - RNA, 1806 nt, Artificial Sequence
  mRNA product Design5 comprising derived and/or modified sequence from Homo sapiens__NP_057383.2__HsHSPA14 (opt8)
gggagagucccgcagucggcguccagcggcucugcuuguucgugugugugucguugcaggccuuauucaagcuuaccauggcagcaaucggcguccaccucggaugcacaucagccugcgucgccgucuacaaagacgggcgcgccggcgucgucgcaaacgacgcgggcgaccgcgucacaccagccgucgucgcauacuccgaaaacgaagaaauaguaggccuagccgccaagcaaucccgcauacgcaacaucagcaacacagucaugaaaguaaaacaaauauuaggccgcuccuccuccgacccacaggcccaaaaauacaucgcagaaucaaaaugccucguaaucgagaaaaacggcaaacuacgcuacgagaucgacacuggcgaagaaaccaaguucguaaacccagaagacgucgcccgccuaaucuucucaaaaaugaaagaaacggcccacucaguccucggcuccgacgccaacgaugucgucauaaccguaccauucgacuucggcgaaaaacaaaagaacgcacuaggcgaagccgcccgcgcagcgggauucaacguccuacgccucauacacgaaccauccgcggcccucuuagcuuacggaaucggacaagacucccccaccggcaagucaaacauccuaguauucaaacuaggaggaaccucacuaucacucucagucauggagguaaacucaggcaucuaccgcguccucagcaccaacacagacgacaacaucggaggagcccacuucaccgaaacacucgcccaguaccucgccuccgaguuccagcgaucguucaaacaugacguacgaggaaacgcacgcgcaaugaugaagcucacgaacagcgcagaagucgcaaagcacucccuaagcacacuaggcagcgcaaacugcuuccuggacucauuauacgaaggacaggacuucgacugcaacguaagccgcgccagauucgaacuccucugcucaccccucuucaacaaaugcaucgaagccauacgcggacuacuagaccaaaacggguucaccgccgacgacaucaacaaagucguucucugcggcggauccagccgcauccccaaacugcaacaacucaucaaggaccuauuccccgccgucgagcugcuaaacuccauaccacccgacgaaguuauacccauuggagcagcaauagaggccggcauccucaucggcaaagagaaccuccucgucgaagacucccugaugaucgagugcuccgccagagacauacucgucaaaggcgucgacgaaucaggagcaucacgcuucacaguccuauuccccucuggaacaccccuuccagcacgacgacaacacacccuacaagcaccaggcagcauuuccuccgucugccuagaacucuacgaauccgauggcaaaaacucggccaaagaagaaaccaaguucgcacaagucguacuccaagaccucgacaagaaagaaaacggacuccgcgacauccuggccgugcucaccaugaagcgagauggaucacuacacgugaccugcaccgaccaggaaaccggcaaaugcgaagccaucagcaucgaaaucgcauccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7024 - RNA, 2853 nt, Artificial Sequence
  mRNA product Design5 comprising derived and/or modified sequence from Homo sapiens__NP_006635.2 __HsHSPH1 (opt8)
gggagagucccgcagucggcguccagcggcucugcuuguucgugugugugucguugcaggccuuauucaagcuuaccauguccgucgucggacuggacgugggaagccaaagcugcuacauagcagucgcccgggcagggggcaucgaaacaaucgccaaugaguucagcgacagaugcacuccaagcgucaucuccuucggauccaaaaacagaacaauaggagucgccgccaaaaaccaacagauaacccacgcaaacaacaccgucucaaacuucaaacgguuccacggcagagcauucaacgaccccuucauacaaaaagaaaaagaaaaccuaucauacgaccucgucccacucaaaaacggaggagucgguaucaaagucauguacaugggcgaagaacaccuuuucucaguagagcaaauaacagcaaugcuacuaaccaaacucaaagagacagcagaaaacucgcugaagaaaccagucacagauugcgucauaagcgucccgagcuucuucaccgacgccgaacgacgcucaguacuagacgcagcccaaaucgucggccugaacugucucagacuaaugaacgauaugacggcagucgcccuaaacuacggcauauacaaacaggaccucccaucacuggaugaaaaaccacguaucguggucuucgucgacaugggccacucagcauuccaagucuccgcaugcgccuucaacaaaggcaaacucaaaguacuaggcacagccuucgacccauuccuugggggcaaaaacuucgacgaaaaacuggucgagcacuuuugcgcagaguucaaaaccaaauacaaacucgacgccaaaagcaaaauccgagcacuucuacgauuauaccaagaaugcgaaaaacucaagaaacucaugagcagcaacucgacagaccuccccuugaacaucgaaugcuucaugaaugacaaggacgugucagggaagaugaaccggucacaguucgaagaacugugcgccgaacuccugcagaaaaucgaagucccacuguacucccuacucgaacaaacccaccugaaagucgaagacgucucagcaguagaaaucgugggaggggcaacccgaauaccugccgucaaagaacguaucgcgaaauucuucggaaaagacaucaguacaacgcucaacgccgacgaagcagucgccagagggugcgcacuccaaugcgcgauccuaucccccgcguucaaaguacgcgaguucuccgugacugacgccgucccauucccaaucucacuaaucuggaaccacgacucagaagacacggaaggaguccacgaagucuucagccgcaaccacgcugcccccuucucuaaaguauuaaccuuccuccgccgagguccauucgaacucgaagcguucuacucagacccacaagggguacccuacccggaggcgaaaaucggccgcuuuguaguacaaaacgucucagcccagaaagacggcgaaaaaucccgggucaaagucaaaguccgcgucaacacccacggcauauucaccaucucaacugccagcauggucgagaaaguaccaacagaggagaacgaaaugucaagcgaagccgacauggaaugccuaaaucaaagaccgccagaaaacccugacaccgacaaaaacguacaacaagacaauuccgaagcagggacccagccacaaguccagacagacgcacaacagaccagccaaucacccccauccccagagcucacgagcgaagaaaacaaaauaccagacgcagacaaggcaaacgaaaagaaagucgaccagccgccagaagcgaaaaagccgaaaaucaaaguagucaacgucgaacuccccauagaagcaaaccucguauggcagcucgggaaagaccuccuaaacauguacaucgagacagaaggcaaaaugauaaugcaagacaaacuagaaaaagaaagaaacgacgcuaaaaacgcaguagaagaguacgucuacgaguuccgcgacaaacucugugggcccuacgaaaaauucaucugcgaacaagaccaccaaaacuuccuaagacuccuaaccgaaacggaagacuggcucuacgaagaaggcgaggaccaagcaaaacaagccuacgucgauaaacucgaggagcuaaugaaaaucggcacgcccgucaaaguccgcuuccaagaagcagaagaacgaccgaagauguucgaagaacugggccagcgcuugcaacacuacgcgaaaauagcggccgacuuccgcaacaaagacgaaaaauauaaccacauagacgaaucagagaugaaaaagguagagaaaagcguaaacgaaguaauggaauggaugaacaacgucaugaacgcccaagccaagaaaucacuagaccaagaccccguugucagagcccaagaaauaaaaaccaaaauuaaagaacucaacaacacaugcgagccagucgucacccaaccgaaaccaaaaauagaaucuccaaaacucgaaagaaccccaaacggcccuaacaucgauaagaaagaagaggaucucgaagacaaaaacaacuucggggcagaacccccgcaccaaaacggcgaaugcuaccccaacgagaaaaacucugugaacauggaccuagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7025 - RNA, 3276 nt, Artificial Sequence
  mRNA product Design5 comprising derived and/or modified sequence from Homo sapiens__NP_006380.1 __HsHYOU1 (opt8)
gggagagucccgcagucggcguccagcggcucugcuuguucgugugugugucguugcaggccuuauucaagcuuaccauggccgacaaaguccgacgacaacgaccgcgccgacgaguauguugggcgcucgucgccguacugcucgccgaccuacuggcccuaagugacacccucgcagugaugaguguagaccuaggcuccgaauccaugaaggucgcgauagucaaaccaggagugccgauggaaauaguccucaacaaggaauccaggcgaaaaaccccaguaauaguaacccucaaagaaaacgagcgguucuuuggagacucagcagcaagcauggcaaucaagaauccaaaagccacccuacgauacuuccaacaccuacuaggaaagcaggcagacaacccacacgucgcacuauaccaggccagguucccggaacacgagcugaccuucgacccccaaaggcaaacgguacacuuccaaaucagcagccaacuacaauucagcccagaagaaguccucggaaugguccuaaacuacagcagaagccucgcagaggauuucgccgaacagccaauaaaagacgccguaauaacagucccaguauucuucaaccaagccgagcgacgagccguccuacaggcagcacgcauggccgggcucaagguacuccagcuaauaaacgacaacacggcaacggcccuauccuacggagucuuucggagaaaagacauaaacacaaccgcacaaaacauaauguucuacgacaugggcucaggcucgacagucugcacaauagucacauaccagauggucaaaacaaaggaagccgggaugcaaccgcaacugcaaauacgaggagucggauucgaccgaacacugggaggacuagaaauggaacuacgacuccgagagaggcuggccggccuauucaacgaacaaagaaaaggccaacgcgcaaaagacguaagggaaaacccacgagcaauggcuaaacuacuccgagaagccaaccgacugaaaacaguacuaagcgcaaacgcagaccacauggcgcaaauugaagggcuaauggacgacguagacuucaaagcaaaagucacccgcguggaguucgaggaacucugcgcagaccuguuugaacgcguccccggccccguacaacaagcacugcaaagcgcagaaaugagccuagacgagauagaacaaguaauccuaguaggcggcgccacacgaguacccagaguucaagagguacuacugaaagcugucgggaaagaggaacuaggcaaaaacaucaacgccgacgaggccgcagcaaugggagccguauaucaagcagcagcauuaaguaaagcauucaagguaaagccguuuguaguacgggacgccgucguauacccaauuuuagucgaguucacgcgggaagucgaagaggaacccggaauacacucacugaaacacaacaaacgcguccuauucucacgaaugggucccuacccacaaagaaaaguaauaaccuucaaccgauacagccacgacuucaauuuccacaucaacuacggcgaccuuggauuccuagggcccgaagaccugagagucuucggaagccagaaccucaccacagucaaacugaaaggagugggggacagcuucaagaaauacccagacuaugaaucaaaaggaauaaaggcacacuucaaccucgaugaaagcggaguacugagccuggacaggguagaaagcguuuucgagacacugguggaagacagugccgaagaagagagcacacuaacaaaacugggcaacacaaucaguagccucuucgggggcggaacaacgccagacgcaaaagaaaacgggaccgacaccguacaagaagaagaagaaagcccagccgaaggaagcaaggacgagccaggagagcagguagagcucaaagaagaagcagaggcgcccguagaagacggcucucagccaccuccgcccgaacccaaaggagacgcaacaccagagggagagaaggcgaccgaaaaagaaaacggcgacaaaagcgaggcgcaaaaaccgucggagaaagccgaggcgggaccagaaggaguagccccagcacccgaaggcgaaaagaaacaaaaaccagcgagaaaaagaaggaugguggaggaaaucggcguggaacugguagugcuagauuuacccgaccucccagaagacaaacucgcgcagucgguacagaaauuacaagaccugacacuaagagaucuugaaaaacaagaacgagagaaggcggcaaacagucuggaagcguucaucuucgagacgcaggacaaacuauaccagccggaguaccaagagguaucaaccgaagaacaaagagaggaaaucuccggcaagcuaucggcggccucaacauggcucgaggaugaagggguaggcgccaccacagugaugcuaaaagaaaagcuagcugaacuaagaaaacuaugccaaggucuauuuuuccgagucgaggaaaggaagaaauggccagaaagacuaucggcccucgacaaccuacuaaaccacuccagcauguuucuaaaaggcgcgagacuaauaccagagauggaccaaaucuucacggaagucgaaaugaccacacuagaaaaagugauaaacgagacgugggcauggaaaaaugccacacucgcagaacaagccaaacuacccgcaacggaaaagcccguccuacucagcaaagacaucgaagcaaaaaugauggcguuagaccgcgaaguacaguaccuacuaaacaaagcgaaauucaccaaaccacgaccccgccccaaagacaaaaacggcacacgggcagagccaccacugaacgcaagcgccucagaccaaggggaaaaggucauacccccggccggacaaaccgaagacgcggaaccaauaagcgagcccgaaaagguggagacgggaagcgaacccggcgacacagagccacuggaacuaggaggcccgggcgcagaaccagagcaaaaggaacaaagcacagggcaaaagaggccacucaaaaacgaugaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7026 - RNA, 2475 nt, Artificial Sequence
  mRNA product Design5 comprising derived and/or modified sequence from Homo sapiens__NP_005339.3 __HsHSP90AA1 (opt8)
gggagagucccgcagucggcguccagcggcucugcuuguucgugugugugucguugcaggccuuauucaagcuuaccaugccagaagaaacgcaaacgcaagaccaaccaauggaagaggaggaaguagaaacguucgccuuccaggcagagaucgcccaacuaaugagccugauaauaaacacauucuacucgaacaaagagauauuccucagagagcucauaagcaacagcucggacgcacuggacaaaauacgauacgaaucccuaaccgacccgagcaaacucgacuccggcaaagaacuccacaucaaccuaauaccaaauaaacaggaccggacacucaccaucgucgacacagggauaggaaugacaaaagcggaccugaucaacaaccuaggaacgauugcaaaaagcggaacaaaagcguucauggaagcccuccaagcaggcgccgauauauccaugauaggacaauucggcgugggguucuacucagcauacuuagucgcggaaaaagucacgguaauaacgaaacacaacgacgacgaacaguacgcgugggagagcuccgcaggcggcagcuucacaguuaggacagacaccggagagcccauggggcgagggaccaaggucauccuucaccucaaagaagaccaaacggaauaccucgaagaaaggcgcauaaaggaaaucgugaagaaacacucccaauucauaggauacccuaucacacuauucguagaaaaagaacgcgacaaagagguaagcgacgacgaagcggaagagaaggaagacaaggaagaggaaaaagagaaggaagagaaagaaagcgaagacaagcccgaaauagaagacguaggcucggacgaggaagaagaaaagaaagacggcgacaaaaagaagaaaaagaaaauaaaagaaaaauacauugaccaggaggaacucaacaaaacgaaaccgauauggaccaggaacccggacgacaucacaaacgaagaauacggggaguucuacaaaucgcucacaaacgacugggaagaccaccuagcggucaaacacuucaguguggagggacaacuagaguucagagcacuccuguucgucccaaggcgagccccauucgaccuauucgaaaaccgcaaaaagaaaaacaacauaaaacucuacgucagaagagucuuuauaauggacaacugcgaggaacuaauccccgaauaccuaaauuucauccgaggggucguggacucugaagaccucccacuaaacaucucaagagaaaugcugcagcaaaguaagauccuaaaagugauccgcaaaaaccuaguaaagaaaugccuggaacuguucacggaacuggcggaggauaaagaaaacuacaaaaaguucuacgaacaauucuccaagaacauuaaacuggggauccacgaagacucccaaaacagaaagaaacugagcgaacuccugcgauacuacaccagcgcguccggagacgagauggucagccuaaaggacuacugcaccagaaugaaagaaaaccaaaaacacaucuacuauauaacaggggaaaccaaggaccaagucgcaaacagcgccuuuguagagcgccugagaaaacacggacucgaagucauauacaugauagaaccaaucgacgaauacugcguacagcagcugaaggaguucgaaggaaaaacgcuaguaucgguaacgaaagagggacuagagcuacccgaagacgaggaagagaaaaagaaacaagaagaaaagaaaaccaaauucgagaaccucugcaaaauaaugaaagacauccuagaaaagaaaguagaaaaagucguagugucaaaccgccucgucacgagcccauguugcauagucacgucaaccuacggauggacagccaacauggagaggauaaugaaagcccaagcccuacgagacaacucaacaaugggauacauggccgccaagaaacaccuagaaauaaaccccgaccauucgauaauagagacucuccgacaaaaagccgaggccgacaagaacgacaagagcguaaaagaccugguaauccuccucuacgaaacggcccuccuaucaagcggguucagccuagaagacccacaaacccacgccaaccgcaucuacagaaugauaaaacuaggacucggaaucgacgaagacgacccgaccgcggacgacaccucagcagcgguaacagaggaaaugcccccacuagaaggggacgacgacacgagcagaauggaggaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7027 - RNA, 615 nt, Artificial Sequence
  mRNA product Design5 comprising derived and/or modified sequence from Homo sapiens__NG_005218__HsHSP90AA3P (opt8)
gggagagucccgcagucggcguccagcggcucugcuuguucgugugugugucguugcaggccuuauucaagcuuaccauggacuccucaaaacuagacuccggcaaaggacuccacaucaaccucguccccaacaaacaaaaccaaacacucaccauaguagacacacgcaucggcaugaccaaaacagaccucaucaacaaccucggcaccgucaccaaauccggaacaaaagccuucauggaagcacuccaagccgacgcagacaucuccaugaucggacacuucggcgucggcuucuacucagcauaccucgucgccaaaaaagucaccguaaucucaaaacacaacaacgacgaacaauacaccugggaauccuccgcaggcggcuccuucaccguacgaacagacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7028 - RNA, 2451 nt, Artificial Sequence
  mRNA product Design5 comprising derived and/or modified sequence from Homo sapiens__NP_031381.2__HsHSP90AB1 (opt8)
gggagagucccgcagucggcguccagcggcucugcuuguucgugugugugucguugcaggccuuauucaagcuuaccaugcccgaagagguacaccauggugaagaggaagucgagaccuucgccuuccaagccgaaauagcacaauuaaugagccugauaaucaacaccuucuacucgaacaaagaaaucuuccugcgcgaacucaucucgaacgcaagcgacgcccuagacaagauaagauacgaaucacugacagaccccagcaagcuagacucagggaaggagcucaaaaucgacaucauuccaaacccccaagaacggacacuaacccugguggacacagggaucgggaugaccaaggccgaccugauaaacaaccucgggacaaucgccaaaagcggcaccaaagcguuuauggaggcccuacaagccggagccgacaucagcaugaucgggcaauucggcgucggauucuacagcgccuaucuaguagcggaaaaaguaguagugaucacaaaacacaacgacgacgaacaauacgccugggaaagcagugcaggaggcagcuucacggugcgagccgaucacggagaacccauaggacggggcaccaaggugauacugcaccucaaagaagaccaaaccgaauaccuggaagaacgacgaguaaaggaggucguaaagaagcacagccaauucauaggcuacccaauaaccuuguaccuagagaaagaacgggaaaaagagauaagugacgacgaagcugaagaagaaaaaggcgaaaaagaagaagaagacaaagacgacgaagaaaagcccaaaaucgaggacguaggcagcgacgaagaagacgacagcggaaaagacaagaaaaagaaaacaaagaaaauaaaagagaaguacaucgaccaagaagaacucaacaaaacgaagcccauauggacaagaaauccagacgauaucacgcaagaagaauacggagaguucuauaagagucuaaccaacgacugggaagaccaccuagcggucaaacacuucagcgucgaaggacagcuagaguuccgagcccugcuauucaucccccgaagggcacccuucgaccuauuugaaaacaaaaagaagaaaaacaacauuaaacucuacguacgccgcgucuucauaauggacagcugcgacgaacuaauaccagaauaccugaacuucauccgcggagucgucgacagcgaagaccuaccacugaacauaucacgagaaaugcugcaacaaagcaaaauccucaaagucauacgcaaaaacaucguaaagaaaugccuugaacuauuuucggaacuggcagaagacaaagaaaauuacaagaaauucuacgaagccuucagcaaaaaccucaaacugggaauccacgaagacuccacaaaccgaagaagacuaagcgaacuccuaagauaccacaccagucaaagcggcgacgaaaugacaagccucucagaauacgugucccgaaugaaagaaacccagaaaagcaucuacuacaucacgggcgaaagcaaagaacaaguagcaaacagugcuuucguagaacgggugagaaagcgaggauucgaagucguguauaugaccgaaccaaucgacgaauacugcguacaacaacuaaaagaguucgauggcaagucccucguaucagucacgaaagaaggccuagaacugccggaagacgaagaagagaaaaagaaaauggaagaaagcaaagcaaaauucgaaaaccugugcaaacucaugaaagaaauacucgacaagaaagucgaaaaaguaacaauaagcaaccggcuagugagcagcccaugcugcaucgucacaagcacauacggcuggacggcgaacauggaaagaauaaugaaagcacaagcccuacgagacaacagcacgaugggauacaugauggcaaagaagcaccuagaaaucaacccagaccacccaaucguggaaacacuccgacaaaaagccgaagcagacaagaacgacaaggccguaaaagaucuagugguacuacuguucgaaaccgcgcuacucagcucaggauucagccucgaggacccacaaacccacucgaacaggaucuacagaaugaucaaacuaggccugggaauagacgaagacgaagucgccgccgaagaacccaacgcggcagucccagacgaaaucccaccauuggagggagacgaagacgcaagcaggauggaggaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7029 - RNA, 2688 nt, Artificial Sequence
  mRNA product Design5 comprising derived and/or modified sequence from Homo sapiens__NP_003290.1__HsHSP90B1 (opt8)
gggagagucccgcagucggcguccagcggcucugcuuguucgugugugugucguugcaggccuuauucaagcuuaccaugagggcguuauggguccuagggcugugcugcguccuccugacguucggcagcgucagagcagacgacgaaguggacguagacggcaccguagaagaagaccugggaaaauccagagaggguagcagaaccgacgaugaagucgugcagcgagaggaagaagccauccaacucgacgggcugaacgcgucacagauacgggaacuacgagagaaaagcgaaaaauucgccuuccaagcagaagucaaccgaaugaugaaguuaaucauaaacucacuauacaaaaauaaagaaauauuccucagagaacugauaagcaacgcgagugacgcacuagacaaaaucagacucaucagccucaccgacgaaaacgcccuuagugggaacgaagaacuaacagucaaaaucaaaugcgacaaggaaaagaaccuacuacacguaacagacacggguguaggaaugacccgggaggaacucgucaaaaaccucggcaccauagcgaaaagcggaacaucagaguuccucaacaaaaugacagaggcccaggaagacggacaaagcaccagcgaacugaucgggcaauucggaguaggauucuacagcgcguuccucguggcagauaaggucaucgucaccucaaaacacaacaacgacacccagcacauaugggagagcgacagcaacgaguucuccguaaucgcggacccccgcgggaacacgcucggccgcggaaccacaaucacacucguacucaaagaagaagcaagcgacuaccuagagcucgauacaauaaagaaccuggugaaaaaguacagccaguucaucaacuucccaaucuacguauggagcagcaaaacugagacgguagaagaaccaauggaagaagaggaagcagccaaagaagaaaaagaagagucggacgacgaggcagcgguagaagaagaagaagaagagaagaaaccgaaaaccaagaaaguagagaaaacgguaugggauugggaacuaaugaacgacaucaaacccauauggcagcgccccagcaaagaagucgaagaagacgaauacaaggcauucuacaagagcuucagcaaagaaagugacgacccgauggccuacauacacuucaccgcagaaggggaaguaacauucaagagcauacuauucgucccaaccucagcgccgcgaggacucuucgacgaguacgggagcaagaaaagcgacuacaucaaacuguacguaagacgcguauucauaaccgacgacuuccacgacaugaugcccaaauaccuaaacuuugugaaagggguaguagacagcgacgaccuaccccuaaacguguccagagaaacccuccagcagcacaaacuccugaagguaauaaggaagaaacuggugcggaaaacacuagacaugauaaagaaaauagccgacgacaaguacaacgacaccuucuggaaggaguucggcaccaacauaaaacuaggggugaucgaagaccauagcaaccggacccgacucgcaaaacuccuaagauuccaaucaagccaccaccccaccgacauaacgagccucgaccaguacguggaaaggaugaaggaaaagcaagauaaaaucuacuuuauggcgggcuccucccgaaaagaagcagaaagcucacccuucguagagcgacuacucaagaaaggguacgaaguuauauaccugacagaaccuguggacgaauacugcauacaagcacugccggaguucgauggcaaacgcuuccaaaacguggcaaaagaaggcguaaaauucgacgaaagcgagaaaacgaaagaaucacgcgaagcaguagaaaaagaguucgaaccccuacucaauuggaugaaagacaaagcauuaaaagacaaaauagaaaaagcaguagugagccaacgcuugaccgaaagcccgugugcccucguagcaagccaguacggcuggagcgggaacauggagagaaucaugaaagcgcaggcguaccaaacaggaaaagacauauccaccaacuacuacgcuucacaaaagaaaaccuucgaaauaaacccaagacauccgcuaauccgcgacaugcugcgacgaauaaaggaggacgaagacgacaagacaguacucgaccucgcagucguccucuucgaaaccgcaacgcuacggucaggcuaccugcucccagacacgaaagcauacggagacaggauagagaggaugcucagacuaagccuaaacauagacccggacgccaagguagaagaagaaccagaggaagaaccggaagaaacggcagaagacaccacagaggacacagagcaagacgaggacgaggaaauggacguaggaacugaugaagaagaagaaacggccaaagaaucgacagcagaaaaggacgaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7030 - RNA, 2391 nt, Artificial Sequence
  mRNA product Design5 comprising derived and/or modified sequence from Homo sapiens__NP_057376.2__HsTRAP1 (opt8)
gggagagucccgcagucggcguccagcggcucugcuuguucgugugugugucguugcaggccuuauucaagcuuaccauggcacgagaacuaagggcccuccuccuuuggggccgacgccuccgcccgcuacuucgcgcgccagcacuggcagcugucccaggaggcaaacccauccuaugcccccgccgaacaaccgcacagcucggucccagacgcaacccagcuuggucccuucaagcaggccgccucuucuccacucaaacagcagaagacaaagaagaaccacuccacagcauaaucucaucaaccgaaucaguacaaggcucaacaucuaaacacgaguuccaagccgaaacuaagaaacugcucgacauaguggccagaucccuauacuccgaaaaagaagucuucauccgcgaauugaucucaaacgcauccgacgcacucgaaaaacuacgacacaaacucgucuccgacggccaagcccucccagaaauggaaauccaucugcaaacuaacgccgaaaaaggcaccauaacaauccaggacacaggcaucggcaugacccaagaggaacuugucuccaaccucggaacaaucgcccgcagcggauccaaagcauuccucgacgcccuacaaaaccaagcagaagcaagcuccaaaaucaucggacaauucggagucggcuucuacucagccuucauggucgccgaccgcgucgaaguguacucacgcucagcugcacccggaagucuaggcuaucaauggcuaucagacggaagcggggucuucgaaaucgcagaagccucuggcgugcgcacaggcaccaaaaucaucauccaccugaaauccgacugcaaagaguucucgagcgaagcacgagucagggacguuguaaccaaauacucaaacuucguauccuuuccacuauaccucaauggccgucgaaugaacacccuccaagcaaucuggaugauggacccuaaagacguaagagaauggcaacacgaagaguucuaccgcuacguugcccaagcucacgacaaaccacguuacacccugcacuacaaaaccgacgcaccccugaauauccgaagcauuuucuacguccccgacaugaaacccucuauguucgacguaucccgcgaacucggcuccucagucgcccuauacucccgcaaaguccuuauacaaaccaaagccaccgacauacucccaaaauggcuccgcuuuauacgaggagucgucgacucagaagacaucccgcucaaccugagccgagaacuacuccaagaauccgcccucauucgcaaacugcgugacguccuccaacaacgccucaucaaauucuucaucgaccaaucaaagaaagacgccgaaaaauacgcuaaauucuucgaagacuacggccuauucaugcgcgaaggaaucgugaccgccacagaacaagaggucaaagaagacauagccaaacuccuaagauacgaauccuccgcacugcccucgggacaauuaaccucacuauccgaauacgcaagccguaugcgcgccgggacccgcaacaucuacuaccucugcgcccccaaccgacaccuggcagagcacuccccauacuacgaggcaaugaaaaagaaagacaccgaaguccuuuucugcuucgaacaauucgacgaacuaacccucuuacaccuaagggaguucgacaaaaagaaacucaucucaguggaaacggacaucguagucgaccacuacaaagaagaaaaauucgaagaccgcucaccagccgcagaaugucuauccgaaaaagaaacagaagaacucauggccuggaugcgcaacguccuaggcagucgcgucacaaacgucaaaguaacccuuagacuugacacccaucccgccaugguaacaguccucgaaaugggagccgcacgccacuuccuaagaaugcagcaacuagccaaaacacaagaagaaagagcccaacuccuacaaccuacacuagaaaucaacccccgccacgcacucaucaagaaacuaaaccaacuacgcgcaagcgaaccaggccuagcgcaacuccuaguagaccaaaucuacgaaaacgccaugauagcagcaggccuaguagacgacccccgcgccauggucggccgccucaacgaacuccuaguaaaagcccucgaaagacacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7031 - RNA, 738 nt, Artificial Sequence
  mRNA product Design5 comprising derived and/or modified sequence from Homo sapiens__NP_000609.1__HsIGF1 (opt8)
gggagagucccgcagucggcguccagcggcucugcuuguucgugugugugucguugcaggccuuauucaagcuuaccaugggcaaaaucuccucacuccccacacaacuauucaaaugcugcuucugcgacuuccucaaagucaaaaugcacacaauguccuccucacaccucuucuaccuagcccucugccuacucaccuucacaucaucagccacagccggcccugaaaccuuaugcggagccgaacucguagacgcccuccaauucgucugcggagaccgaggcuucuacuucaacaaacccaccgguuacggaucaucaucccgccgcgccccacaaacaggcaucgucgacgaaugcugcuuccgcucaugcgaccuccgaagacuagaaauguacugcgcaccccucaaacccgccaaauccgcccgcuccguccgagcccaacgccacacagacaugcccaaaacacaaaaagaaguccaccucaaaaacgccucccgaggauccgccggcaacaaaaacuaccgcauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7032 - RNA, 819 nt, Artificial Sequence
  mRNA product Design5 comprising derived and/or modified sequence from Homo sapiens__NP_000603.1__HsIGF2 (opt8)
gggagagucccgcagucggcguccagcggcucugcuuguucgugugugugucguugcaggccuuauucaagcuuaccaugggcauaccaaugggcaaauccaugcuaguacuccuaaccuuccuugccuucgcauccugcugcauagccgccuaccgacccuccgaaacacucugcggcggcgaauuagucgacacccuacaauucgucugcggcgaccgcggcuucuacuucucccgaccagccucccgcgucuccagacgcucacgcggcaucguagaagaaugcugcuuccgaucaugcgaccucgcccuccucgaaaccuacugcgccacccccgcaaaaucagaacgagacgucucaaccccacccaccguccuccccgacaacuuccccagauaccccguaggcaaauucuuccaauacgacaccuggaaacaauccacccaaagacuuagacgcggccuccccgcccuacuccgagcccgccgcggacacguacucgccaaagaacucgaagccuuccgcgaagccaaacgccaccgcccacucaucgcccuacccacacaagaccccgcccacggcggcgcacccccagaaauggccucaaaccgaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7033 - RNA, 915 nt, Artificial Sequence
  mRNA product Design5 comprising derived and/or modified sequence from Homo sapiens__NP_000591.1__HsIL6 (opt8)
gggagagucccgcagucggcguccagcggcucugcuuguucgugugugugucguugcaggccuuauucaagcuuaccaugaacuccuucuccacaucagccuucggccccgucgccuucucccucggacuccuccuuguccucccagccgccuuccccgccccagucccccccggcgaagacucaaaagacguagccgccccccaccgacaaccccuuaccuccuccgaacgcaucgacaaacaaauacgauacauccuagacggcaucucagcccuccgcaaagaaaccugcaacaaauccaacaugugcgaaucuuccaaagaagcccuagccgaaaacaaccucaaccuccccaaaauggccgaaaaagacggcugcuuccaaucaggauucaacgaagaaaccugccuugucaaaaucaucaccggccuccucgaauucgaagucuaccucgaauaccuccaaaaccgcuucgaaucauccgaagaacaagcccgcgccguccaaaugucaacaaaaguccucauacaauuccuccaaaaaaaagccaaaaaccucgacgccauaaccacccccgaccccaccaccaacgccucacuacuaaccaaacuccaagcccaaaaccaauggcuacaagacaugaccacccaccucauccuccgcuccuucaaagaauuccuacaaagcucccuccgcgcccuacgccaaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7034 - RNA, 1557 nt, Artificial Sequence
  mRNA product Design5 comprising derived and/or modified sequence from Homo sapiens__NP_002183.1__HsINHBA (opt8)
gggagagucccgcagucggcguccagcggcucugcuuguucgugugugugucguugcaggccuuauucaagcuuaccaugccacuacuauggcuccgcggcuuccuacuggccucaugcuggaucaucguacgcagcagccccacaccaggaagcgagggacacagcgcagccccagacugcccaagcugcgcccuagcggcccugccaaaagacguacccaacagccaacccgaaaugguagaagccgucaaaaaacacauacuaaacaugcuacaccuaaaaaaaaggccagacguaacacaacccgucccaaaagcagcacuacucaacgcaauccgcaaacuccacgucgggaaagucggagaaaacggauacguagagauagaagacgacaucgggcgccgcgccgaaaugaacgaacucauggaacaaaccucagagauaaucacguucgccgaaagcggaacagcccgcaaaacacuacacuucgaaauaagcaaagaaggcagcgaccuaagcgucgucgagcgcgcagaagucuggcucuuccucaaaguacccaaagcaaaccgcacacgaacaaaagucacaauacgacuguuccagcaacaaaagcacccacaaggcucccucgacacaggcgaagaagcagaagaaguaggccuaaaaggagaacggagcgaacuacuccuaucagaaaaagucguagacgcacgcaaaagcacguggcacgucuucccaguaagcagcagcauacaacgacuacucgaccaaggcaaaagcagccucgacgucagaauagcaugcgaacaaugccaagaaucaggcgccucccucguccuacugggaaaaaaaaagaaaaaagaagaagaaggcgaaggaaagaaaaaaggcgguggagaaggaggcgcaggagcggacgaggaaaaagaacaaucccaccgcccauuucuaaugcugcaagcacggcaaucagaagaccacccccaccgccgccgacgacgaggacuagaaugcgacggaaaagucaacaucugcugcaaaaaacaauucuucgucagcuucaaagacauaggauggaacgacuggauaauagcgccaagcggauaccacgcaaacuacugcgaaggcgaaugccccagccacauagcaggcacaagcgggagcagccugucguuccacagcaccgugaucaaccacuacagaaugagaggacacuccccauucgcaaaccugaaaucgugcugcguccccaccaaacuacgaccgaugagcaugcucuacuacgacgacggacagaacaucauaaaaaaagacauacaaaauaugaucguggaagagugcggaugcagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7035 - RNA, 1500 nt, Artificial Sequence
  mRNA product Design5 comprising derived and/or modified sequence from Homo sapiens__NP_002184.2__HsINHBB (opt8)
gggagagucccgcagucggcguccagcggcucugcuuguucgugugugugucguugcaggccuuauucaagcuuaccauggacggccugccaggccgagcguuaggcgccgccugccuccuacuccuagcagcaggcuggcucggccccgaagccuggggaucaccaaccccaccaccaacccccgcagccccucccccacccccaccacccggcagucccggcggaucacaagauaccugcaccucaugcggcggauuccgcagaccagaagaacucggacgcguagacggagacuuccucgaagccguaaaaagacacauacuaucccgccuccaaaugcgcggccgacccaacaucacacacgccguccccaaagccgccauggucaccgcccuacgcaaacuacacgccggcaaaguucgcgaggacggccgagucgaaaucccacaccucgacggccacgccucccccggcgcagacggacaagaacgaguuagcgaaaucaucuccuuugccgaaacagacggccuagccucaucacgaguccgacucuacuuuuucaucuccaacgaaggaaaccaaaaccucuucgucguacaagcaucccuauggcuauaccuaaaacuccuacccuacgucuuagaaaaaggaucccgccgcaaaguccgcgucaaagucuacuuccaagaacagggccacggcgaccgcuggaacauggucgaaaaacgcguagaccucaaacgcuccggcuggcacaccuucccccuaaccgaagccauccaagcccucuucgaacgcggcgaacgacgccuaaaccucgacguacagugcgacucaugccaagaacucgccguaguacccguauucgucgacccaggggaagaaagccacagaccauucgucgucguccaagccagacucggcgacucccgacaccgcauacgcaaacgaggccucgaaugcgacggccgcacaaaccucuguugccgccaacaauucuucaucgacuuccgccuaaucgguuggaacgacuggauuauagccccaacaggauacuacggcaacuacugcgaagggucaugccccgccuaccuagccggaguccccggcucugccagcucauuccacacagcagucgugaaccaauaccgcaugcgaggccuaaaccccggcaccguaaacucuugcugcauccccacaaaauuaucaaccauguccaugcuuuacuucgacgacgaauacaacauagucaaacgcgacguccccaacaugauaguagaagaaugcggcugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7036 - RNA, 3735 nt, Artificial Sequence
  mRNA product Design5 comprising derived and/or modified sequence from Homo sapiens__NP_000623.2__HsITGAM (opt8)
gggagagucccgcagucggcguccagcggcucugcuuguucgugugugugucguugcaggccuuauucaagcuuaccauggcacuucgcguccuccuccuuaccgcccuaacccuaugucauggauucaaccucgacaccgaaaaugccaugaccuuucaagaaaacgcccgcggauucggccagucuguaguacagcuccaaggaucuagaguagucgucggugccccucaagaaaucguagcagcaaaccaacgcgguagucuauaccaaugugacuacucuacuggcucgugcgaaccuaucaggcuccaaguccccguggaagccgucaacauguccuuaggacuaucacuggccgccaccaccuccccaccgcaacuccuagccugcggacccaccguacaccaaacauguagcgaaaacacguacgucaaaggacucuguuuucucuucggcagcaaccuacgccaacaaccccaaaaauucccugaagcccucagaggcugcccacaagaagacuccgacauagccuuccucaucgacggauccggcuccauuauaccccacgacuuccggaggaugaaagaauuugucucgacgguaauggagcaacucaagaaaucaaaaacacuguucagccuaaugcaauacucggaggaguuccgaauccacuucaccuucaaagaguuccaaaacaaccccaacccccguagccuuguuaaacccauaacccaacuacugggccgaacacacaccgccaccggcauccgcaaagucguccgcgaacuauucaacauaaccaacggcgcacgcaaaaaugcuuucaagauacuuguaguaaucacagacggagaaaaauucggagacccauugggauacgaagacgucauuccugaagccgaccgagaaggcguaaucagauacgugauagguguaggcgacgcauucagaucagaaaaaucacgccaagaacuaaacacaauagccuccaagccaccccgagaccaugucuuccagguaaacaauuucgaggcacuuaaaacuauucagaaccagcuccgugagaaaaucuucgccaucgaaggaacucagacaggauccuccucgucuuucgaacaugagaugagccaagaaggcuucagcgcugccaucaccucuaacggacccuugcuaucuacagucggcuccuacgacugggccggcggcguguuccucuacaccuccaaagaaaaauccacguucauaaacaugacacgagucgacucggacaugaaugacgcguaccuugguuaugcugccgcaauuauacuuagaaaccgugugcaaucccuuguacucggcgcucccagauaucaacacaucggccucgucgcuauguuucgucaaaauaccgggaugugggaauccaacgccaaugucaaaggcacccaaaucggcgccuacuucggcgcgagccuaugcucagucgacgucgacucaaacggauccaccgaucuaguccugaucggagcaccacacuauuacgaacaaaccagaggcggccagguaucagucugcccacucccccgaggccgcgcccgcuggcaaugcgacgccguccuuuacggcgagcagggccagccuuggggacgauucggagccgcccucaccguacucggugacguuaacggagauaaacuaacagacgucgcaaucggcgcccccggagaagaagacaacagaggagcggucuaccucuuucacggaaccuccgggagcggaaucagcccgucccauucccagcgcauugcagguagcaaacucaguccccgccuccaguacuucggccaaucccuguccggcggccaagaccuuacaauggacggccuaguagaccucaccgucggugcucagggccauguccugcuucuacgcucucaaccagucuuacgaguaaaagcaauaauggaguucaacccacgcgaagucgcccgcaacgucuucgaaugcaacgaccaggucguaaaaggcaaagaagccggagaaguccguguaugccugcacguacaaaaguccacccgcgaccgccuacgggaaggccaaauacagucugucgucacuuaugaccucgcucucgacuccggaagaccgcacucucgggccgucuuuaacgaaaccaaaaacucaacacgacgacaaacacaggugcucggccugacgcagacaugcgagacgcucaaauugcagcuaccaaacugcaucgaagacccaguaagcccuauuguccuucgccuaaacuucagccucguggggacaccacuaagcgccuucggcaaccuacgcccgguacucgcggaagacgcccagcgccucuucaccgcccuuuuucccuucgagaaaaacugcggcaacgauaacaucugccaagacgaucugucgaucaccuucagcuucaugucccucgacugucucguagucggaggcccccgugaguucaacguaaccguaaccguccgcaacgacggagaagacagcuaccgcacucaggucaccuuuuucuucccccucgaccugucuuacagaaaaguaucaacacuccaaaaccaacgaucccaacguucauggcgacuagccugcgaauccgccagcuccacugaagucagcggcgcccucaaaagcacguccugcucgaucaaccaccccauauuccccgagaacucagaagucacauucaacaucacauucgacguagauucaaaggcuucacucggaaauaaacugcuucucaaagccaacgucaccucagaaaauaauaugccccguacuaacaaaaccgaguuucaacuagaacucccggucaaauacgccgucuacaugguaguaaccucucacggaguauccaccaaguaccucaacuucacugcauccgaaaacacuucucgcgucaugcagcaccaauaucaagucuccaaccucggucaacguucacugcccaucucccuaguauuccuggucccaguacgccuaaaccagaccgucauaugggacagaccccaagucaccuucucagaaaaccuuagcucuaccugccauacaaaggaaagauuacccucacacuccgacuuucucgcagagcucaggaaagcccccguagucaacugcucgauagcaguaugccaacgaauacaaugcgauaucccauucuuuggcauccaggaagaguucaacgccacccugaaggguaaccucucauucgacugguacauaaagacaucacauaaccaucuacuuauagucagcacagccgaaauccuguucaacgacucaguguucacccuccugcccggccaaggagccuucguacgcucacaaaccgaaacaaaaguugaaccuuucgaaguucccaacccccuuccgcucauagucggcuccucagucggaggccuccuccuacucgcccuaauaaccgcagccuuguacaaacucggauucuucaaacgccaguacaaagacaugaugucagaaggagguccucccggcgcagaaccacaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7037 - RNA, 1680 nt, Artificial Sequence
  mRNA product Design5 comprising derived and/or modified sequence from Homo sapiens__NP_002415.1__HsMMP8 (opt8)
gggagagucccgcagucggcguccagcggcucugcuuguucgugugugugucguugcaggccuuauucaagcuuaccauguucucacuaaaaacccuacccuuucuccuacuccuucacguccagauaucaaaagccuuccccgucuccucuaaagagaaaaacaccaaaaccgugcaagacuaccucgaaaaauucuaccaacucccguccaaccaauaccaaucaacacgcaaaaacggcacuaacguaaucgucgaaaaauugaaagaaaugcaacgauucuucggccucaacgucaccggcaaacccaacgaagaaacccucgacaugaugaagaaaccccgaugcggaguacccgacucuggcggcuucaugcucacucccggcaaucccaaaugggaacgcacuaaccucaccuaccgcaucagaaauuacacaccccaacucucagaagccgaagucgaaagagcgauuaaagacgcauucgaacuaugguccgucgccagcccccuaaucuucacccgcaucucccaaggugaagccgacaucaacauagcauucuaccaacgcgaccacggugacaacuccccauucgacggcccaaacggcauacuugcccacgcauuccaacccggucaaggaaucggaggcgacgcccacuucgacgccgaagaaaccuggaccaacacauccgcaaacuacaaccuauuccucguugccgcccacgaguucggccacucccuaggcuuagcacacuccuccgauccaggugcccuaauguauccaaacuacgccuuccgcgaaaccuccaauuacucccuaccccaagaugacaucgacggaauccaagcaaucuacggacucucauccaaccccauccaacccaccgguccaucaaccccaaaacccugcgaccccucccucaccuucgacgcaaucaccacucucagaggugaaauccucuucuucaaagaccguuacuucuggcgaagacacccacaacuccaacgcgucgaaaugaacuuuauuucacucuucuggcccucgcuucccaccggcauccaggccgcauacgaagacuucgaccgcgaccuaaucuuccucuucaaagguaaccaauacugggcacuaucaggcuacgacauccuucaaggcuaccccaaagacauauccaacuacggcuucccauccuccguccaggcaaucgacgcugcagucuucuauagauccaaaaccuacuucuucgucaacgaccaauucuggcgauacgacaaccaacgacaauucauggaacccggcuaccccaaaucaaucuccggcgcuuuccccggcaucgaauccaaagucgacgccguuuuccaacaagaacacuucuuccacgucuucuccgggccacgauacuacgccuucgaccucaucgcccaacgcgucacccgaguagcacgcggcaacaaauggcuuaacugccguuacggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7038 - RNA, 2400 nt, Artificial Sequence
  mRNA product Design5 comprising derived and/or modified sequence from Homo sapiens__NP_004985.2__HsMMP9 (opt8)
gggagagucccgcagucggcguccagcggcucugcuuguucgugugugugucguugcaggccuuauucaagcuuaccaugucccucuggcaaccccuaguucuaguccuccucguacuuggaugcugcuucgcagcaccccgacaacgccaauccacccuaguccucuucccuggcgaucuucgaacaaaccugaccgaccgccaacucgcggaagaauaucucuaccgcuacggcuacacacguguagccgaaaugcgcggagaauccaaaagccuagguccagcacuccuccuccuccaaaaacaacuuucacuccccgaaacgggcgaacucgacuccgccacccucaaagcaaugagaacaccacgcugcgggguacccgacuuagggagauuccaaacguucgaaggagaccuaaaguggcaccaccacaacauaacuuacuggauacaaaacuacagcgaggaccugccccgagcagucaucgacgacgccuucgcaagagccuucgcccuauggagcgccguaacaccccucaccuucacccguguauacucccgagacgccgacauugucauccaauucggcguagccgaacacggagacggcuacccauucgacggcaaagacggccuauuggcacacgcauuuccacccggcccaggaauacaaggcgacgcccacuuugacgaugacgaacucuggagccugggaaaaggagucguaguccccaccagauucggcaacgcagacggagcagcaugccacuuccccuuuauauucgaaggccgcucuuacagcgccugcacuaccgauggccgcuccgauggucuacccuggugcuccaccaccgccaacuacgacaccgaugaucgcuucgguuucuguccaucugaaagacucuacacccaggacggcaacgccgacggcaaacccugccaauuuccauucaucuuccaaggccaaucuuacuccgcaugcaccacagacggccgauccgauggauaucgcuggugcgccacaacugccaauuacgaccgagacaaacucuucggauucugcccaacccgagcagacucaaccguaaugggaggaaacucagccggcgaauuaugcguauuucccuucaccuuccucggaaaagaguacuccacgugcaccagcgaaggccgaggagacggacgacuauggugcgccaccacaucaaacuucgacuccgacaagaaauggggcuucugccccgaucaaggcuacucucuguucuuagucgccgcacacgaguucggacacgcccugggacuagaccacaguucaguccccgaagcgcucauguaccccauguaccgcuucacagaaggaccaccacuacacaaggacgacguaaacggcaucagacaccuauaugguccccgaccagaacccgaaccacgcccucccacuaccacuaccccacaaccaacugccccacccacaguauguccaacaggaccacccaccguacaccccuccgaacgccccaccgccggcccuaccggaccucccuccgcaggucccacaggaccacccacagccggccccuccaccgccaccacaguucccuuauccccugucgacgacgcaugcaacgucaacauauucgacgcuaucgccgaaaucggcaaucaacuauaccuguucaaggacggcaaauauuggcgcuucucagaaggccgaggcagccgcccucaagguccauuccucauugccgacaaauggcccgcccuccccagaaaacuugacuccgucuucgaagaacgucucuccaagaaauuauucuucuucucaggccgucaagucugggucuacaccggcgccagcguccucggccccagacgucuagacaaacuuggacucggagccgacgucgcucagguaaccggggcucugcgauccggacgcgggaagauguugcuauucagcggacgcagacuauggcgcuucgacgucaaagcccaaauggucgacccgagauccgccuccgaaguugaccguauguucccaggcgugccccucgacacccacgacguauuccaauaccgcgaaaaagcauacuucugccaggaccgcuuuuauuggcgagucucuucccgaucugaacuuaaccaagucgaccaaguaggauaugucaccuacgacauccuccagugccccgaggacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7039 - RNA, 1692 nt, Artificial Sequence
  mRNA product Design5 comprising derived and/or modified sequence from Homo sapiens__NP_002418.1__HsMMP13 (opt8)
gggagagucccgcagucggcguccagcggcucugcuuguucgugugugugucguugcaggccuuauucaagcuuaccaugcacccaggcguccucgcagcuuuccucuuccucuccuggacacacugccgcgcauuaccccuccccucaggaggcgacgaagacgaccucuccgaagaggaccuccaauucgccgaacguuaccuccgcuccuacuaccacccgacaaaccucgcaggaauacucaaggaaaacgccgccuccuccaugaccgaacgccuuagagaaaugcagucauucuucggccuagaaguaaccggaaaacuagacgacaacacccuagacgucaugaaaaaaccccgaugcgguguccccgacgucggcgaauacaacgucuucccccgcacccuuaagugguccaaaaugaaccugaccuaucgcauagucaacuacacgccagacaugacccauuccgaagucgaaaaagcauucaaaaaagcguucaaaguaugguccgacgucaccccacuuaacuucacacgccuccacgacggaaucgcagacaucaugauaagcuucgguaucaaagaacacggcgacuucuaccccuucgacggcccaucaggccuacuagcccacgcauucccccccggcccgaauuacggcggcgacgcccacuuugacgaugacgaaaccuggacauccuccuccaaagguuacaaccuauuccuaguagccgcacacgaauucggccacucccucgggcuagaccacuccaaagaccccggagcccucauguuccccauauacacuuacaccggcaaaucccacuucaugcuacccgacgacgacguacaaggcauccaaucccuguacggcccaggcgacgaagacccaaaccccaaacaccccaaaacucccgacaaaugcgaccccucccucucccuagacgccaucaccucacuccgcggcgaaacaaugauauucaaagaccguuucuucuggcgccuccacccacaacaaguagaugcagaacucuuccuaacaaaauccuucuggcccgaacuaccaaaccgaaucgacgcugcauaugaacauccaucccacgaccucauuuucauauuucgaggccgaaaauucugggcacuaaacgguuacgacauccucgaaggcuaccccaaaaaaaucuccgaacuaggccuucccaaagaaguaaaaaaaaucucagccgccguccacuuugaagacaccggaaagacucuacuauucucaggcaaccaagucuggcgauacgacgacaccaaccacauaauggacaaagacuaccccaggcuaauagaagaagacuuuccaggcaucggagacaaaguagacgccguauacgagaaaaacggcuacaucuacuucuucaacggccccauacaauucgaguacuccaucugguccaaucgaaucguacgcgucaugcccgccaacucaauccucuggugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7040 - RNA, 1344 nt, Artificial Sequence
  mRNA product Design5 comprising derived and/or modified sequence from Homo sapiens__NP_001286.1__HsCCR1 (opt8)
gggagagucccgcagucggcguccagcggcucugcuuguucgugugugugucguugcaggccuuauucaagcuuaccauggagacccccaacaccacagaagacuacgacaccaccaccgaauucgacuacggugacgccacccccugucaaaaagucaaugaacgcgccuucggcgcacaacuacuaccgccccucuacucgcucguuuucguaaucggccucgucggaaauauacucgucguccucguccuaguccaauacaaacgccucaaaaacaugacuucaaucuaccuccuuaaccuagccaucucugaccuccucuuccuauucacacucccauuuuggaucgauuacaaacucaaagacgacugggucuucggcgacgcaaugugcaaaauccuaucaggcuucuacuacaccggccuauauagcgaaaucuucuucauuauccuucucaccaucgaccgcuaccucgccauaguccacgcagucuucgccuugcgcgcacgcaccguaacuuuuggagucauaaccuccaucaucauuugggcucucgccauccucgccucaaugcccggccuauacuucuccaaaacacaaugggaauucacccaccauacuugcucccuccacuucccacacgagucccuaagagaauggaaacucuuucaagcacucaaauuaaaccucuuuggucucguucuuccccuccucgucaugauaauuugcuacaccggcaucaucaaaauccuccuccgccguccaaacgaaaaaaaauccaaagccguccgccuaaucuucguaauaaugaucaucuucuuccucuucuggacccccuacaaccucacaauccucaucuccgucuuccaagauuuccucuucacccacgaaugcgaacaaucucgucaccucgaccucgcuguccaagucacagaagucaucgcuuacacacacugcugcgucaaccccguaaucuacgcauucgucggugaacgauuccgcaaauaccuccgccaacucuuccaccgccgcguagccguccaccucgucaaauggcuucccuuccucuccgucgaccgacucgaacgcguaucuagcaccuccccuuccacaggagaacacgaacucuccgccggcuucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7041 - RNA, 912 nt, Artificial Sequence
  mRNA product Design5 comprising derived and/or modified sequence from Homo sapiens__NP_002598.4__HsPDGFA (opt8)
gggagagucccgcagucggcguccagcggcucugcuuguucgugugugugucguugcaggccuuauucaagcuuaccaugcgcacccucgccugccuccuccuccucggcugcggcuaccucgcccacguccucgccgaagaagccgagaucccacgcgaaguaaucgaacgccucgcccgcucccaaauacacuccauccgcgaccuccaacgccuccucgaaaucgacucaguaggcuccgaggacucacucgacaccucacuccgcgcccacggcguccacgccaccaaacacguccccgaaaaaagaccacucccaauccgacgaaaacgauccaucgaagaagccguccccgcagucugcaaaacccgcaccgucauauacgaaaucccacgaucccaagucgaccccaccuccgccaacuuccuaaucuggcccccaugcgucgaagucaaacgaugcaccggcugcugcaacacauccuccguaaaaugccaacccagccgcguccaccaccgcuccguaaaaguagcaaaagucgaauacguacgcaaaaaacccaaacuaaaagaaguccaaguccgccucgaagaacaccuagaaugcgcaugcgcaacaacaucccuaaaccccgacuaccgcgaagaagacaccggccgaccacgagaauccggcaaaaaacgcaaacgcaaacgccucaaaccaacauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7042 - RNA, 1002 nt, Artificial Sequence
  mRNA product Design5 comprising derived and/or modified sequence from Homo sapiens__NP_002599.1__HsPDGFB (opt8)
gggagagucccgcagucggcguccagcggcucugcuuguucgugugugugucguugcaggccuuauucaagcuuaccaugaaccgaugcugggcacucuuccuaucccucugcugcuaccuacgccuagucucagccgaaggcgaccccauccccgaagaacucuacgaaaugcucagcgaccacuccauccgaagcuucgacgaccuucaacgccuacuccacggcgaccccggcgaagaagacggagccgaacucgaccuaaacaugacccgcucccacuccggcggagaacucgaaucacucgcacgcggacgcagaucccucggcucccucaccaucgccgaaccagccaugauagcagaaugcaaaacccgaacagaagucuucgaaaucucacgccgccucauagaccgaaccaacgccaacuuccucgucuggcccccaugcgucgaaguccaaagaugcuccggcugcugcaacaaccgcaacguccaaugccgcccaacccaaguccaacuccgcccaguccaaguacgcaaaaucgaaaucguacgcaaaaaaccaaucuucaaaaaagccaccgucacccuagaagaccaccucgccugcaaaugcgaaaccguagccgcagcccgacccguaacacgcucucccggcggcagccaagaacaacgagcaaaaacaccccaaacacgcgucacaaucaggaccguccgcguccgcagacccccaaaaggcaaacaccgcaaauucaaacacacccacgacaaaaccgcacucaaagaaacccuaggcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7043 - RNA, 1314 nt, Artificial Sequence
  mRNA product Design5 comprising derived and/or modified sequence from Homo sapiens__NP_057289.1__HsPDGFC (opt8)
gggagagucccgcagucggcguccagcggcucugcuuguucgugugugugucguugcaggccuuauucaagcuuaccaugucccucuucggccuccuccuccucaccucagcccuagcaggccaacgccaaggcacccaagccgaauccaaccucuccuccaaauuccaauucucauccaacaaagaacaaaacggcguacaagacccgcaacaugaacgcauaaucaccguauccaccaacggcagcauccacuccccaagguucccccauaccuacccccgcaacaccguccuagucuggcgccuugucgccgucgaagaaaacgucuggauccaacugacauucgacgaacgcuucggccucgaagaccccgaagacgacaucugcaaauacgauuucgucgaaguagaagaaccuuccgauggcaccauccucggccgcuggugcggaagcggcaccguccccggcaaacaaaucucaaaaggcaaccaaauacgcauccgauucgucuccgacgaauacuucccaucagaacccggauucugcauacacuacaacaucgucaugccacaauucaccgaagccgucucacccuccguccuaccccccucagcccucccccucgaccuacucaacaacgccauaacagccuuuuccacccucgaagaccucauccgauaccucgaaccagaacgauggcagcucgaccuagaagaccucuaccgccccaccuggcaacucuuaggcaaagccuucgucuucggccgcaaaucgcgcguaguugaccuuaaccuccuaaccgaagaaguacgccucuacagcugcaccccacgcaacuucuccguaucaauccgcgaagaacucaaacguaccgacaccauauucuggcccggaugccuccuagucaaaagaugcggcggaaacugcgccugcugccuccauaacugcaacgaaugccaaugcguacccuccaaaguaaccaaaaaauaccacgaaguccuucaacuccgcccaaaaacaggcguacguggccuccauaaaucacuuaccgacgucgcccucgaacaccacgaagaaugugacugcgucugucgcggauccaccggaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7044 - RNA, 1371 nt, Artificial Sequence
  mRNA product Design5 comprising derived and/or modified sequence from Homo sapiens__NP_149126.1__HsPDGFD (opt8)
gggagagucccgcagucggcguccagcggcucugcuuguucgugugugugucguugcaggccuuauucaagcuuaccaugcaccgccucaucuucgucuacacccuaaucugcgccaauuucugcucaugccgcgacaccucugccacaccgcaaagcgcuucaaucaaagcacuccggaacgccaaccugcgacgagacgaccucuaccgccgcgacgaaaccauccaagucaaaggaaacggcuacguacaaagcccccgauucccaaacuccuacccccgcaaccuccuacucaccuggagacuacacucccaagaaaacacccgaauacaacucguauucgacaaccaauucggacuagaagaagcugaaaacgacaucugccgauacgacuucguagaagucgaagacauaagcgaaacauccacaaucaucagaggccgcuggugcggccacaaagaaguaccaccccgcaucaaaucccgcacaaaccaaaucaagauaaccuucaaaucagacgacuacuucgucgccaaacccggauucaaaaucuacuacucccuccuagaagacuuccaacccgccgccgccuccgaaacaaacugggaaucagucaccucaagcaucucagguguaucauacaacucccccuccgucaccgaccccacacucauagcagacgcccucgacaagaaaauagcugaauuugacaccgucgaagaccuccucaaauacuucaaccccgaauccuggcaagaagaccucgaaaacauguaccuggauacaccacgcuacagaggccgaucauaccacgaccgaaaaaguaaagucgaccuugaccgccucaacgacgacgccaaacgcuauagcugcaccccucgaaacuacuccgucaacauccgagaagaacuaaaacucgcaaacgucguauucuucccacguugccuccuuguccagcgaugcggaggcaacugcggcugcggcaccgucaacuggcggagcugcacaugcaacuccggcaaaaccguaaagaaauaccacgaaguacuccaauucgaaccaggucacaucaaacgucgcggcagagcuaaaaccauggcauuagucgacauacaacuagaccaccacgaacgaugcgacugcaucugcagcucacgacccccacgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7045 - RNA, 954 nt, Artificial Sequence
  mRNA product Design5 comprising derived and/or modified sequence from Homo sapiens__NP_003946.3__HsSOCS3 (opt8)
gggagagucccgcagucggcguccagcggcucugcuuguucgugugugugucguugcaggccuuauucaagcuuaccauggucacacacuccaaauuccccgccgccggcaugucccgacccuuagacaccuccuuacgccuaaaaaccuucuccuccaaauccgaauaccaacucguagucaacgcaguacgcaaacuccaagaauccggauucuacuggucagccguaaccggcggcgaagccaaccuccuccuauccgccgaaccagccggcaccuuccuaauucgcgacucauccgaccaacgccacuucuucacccucuccgucaaaacccaauccggcacaaaaaaccuccgcauccaaugcgaaggcggaucauucuccuuacaauccgacccccgcuccacccaaccagucccccgauucgacugcguacucaaacucguccaccacuacaugccaccccccggcgcccccuccuucccuucaccccccaccgaacccuccuccgaagucccugaacaacccucagcccaacccuuacccggcucccccccacgccgcgcauacuacaucuacucaggcggcgaaaaaaucccacucguccucucccgcccccucuccuccaauguagccacacuccaacaccucugccgcaaaaccgucaacggccaccuagacuccuacgaaaaaguaacccaacuccccggacccauacgcgaauuccuagaccaauacgacgccccacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7046 - RNA, 759 nt, Artificial Sequence
  mRNA product Design5 comprising derived and/or modified sequence from Homo sapiens__NP_003227.1__HsTGFA (opt8)
gggagagucccgcagucggcguccagcggcucugcuuguucgugugugugucguugcaggccuuauucaagcuuaccaugguccccuccgccggccaacucgcccucuucgcccucggcauaguacucgcagccugccaagcccuagaaaacucuaccuccccccucuccgccgaccccccaguagcagccgccgucgucucacacuucaaugacugcccagacucccacacccaauucugcuuccacggcaccugccgcuuccucguacaagaagacaaacccgccugcguaugccauuccggauaugucggcgcccgcugcgaacacgccgaccuccuagcaguagucgcagcaucacaaaaaaaacaagcaaucacagcacuugucgucgucucaaucgucgcccucgccguacuaaucaucaccugcguccucauccacugcugccaaguccgaaaacacugcgaauggugccgagcacucaucugccgccacgaaaaacccucagcccuacucaaaggccgaaccgcaugcugccacuccgaaacagucgucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7047 - RNA, 1449 nt, Artificial Sequence
  mRNA product Design5 comprising derived and/or modified sequence from Homo sapiens__NP_000651.3__HsTGFB1 (opt8)
gggagagucccgcagucggcguccagcggcucugcuuguucgugugugugucguugcaggccuuauucaagcuuaccaugccuccauccggccuacgacuacuccccuuacuccuaccccuccuauggcuccuaguccuaacacccggccgccccgcagccggccuaucgaccugcaaaaccaucgacauggaacucgucaaacgcaaacgcaucgaagccauucgaggacaaauccuauccaaacucagacucgccucaccucccucccagggcgaaguaccacccggcccccuucccgaagcaguccucgcccucuacaacucaacaagagaccgcgucgccggcgaauccgccgaacccgaacccgaacccgaagccgacuacuacgccaaagaaguuacccgagugcuaauggucgaaacccacaacgaaaucuacgacaaauucaagcagucaacacacucaauauacauguucuuuaauaccucagaacuccgcgaagcaguaccugaacccguccuccuaucccgcgccgaacuccgacuucucagacucaaacuuaaggucgaacaacacgucgaacucuaccaaaaauacuccaauaauucauggcgcuaccucuccaaucgacuccuugcccccuccgacucacccgaauggcucuccuucgacgucaccggagucguacgccaguggcucucccgcggcggcgaaaucgaaggcuuccgccucuccgcacacugcuccugugacucccgcgacaauacccuacaagucgacaucaacggcuucaccaccggccgacgcggcgaucucgccaccauccacggcaugaaccgcccauuccuccuccuaauggccacaccccucgaacgugcccaacaucugcaaucaucccgccaccgacgugcccucgacaccaacuacugcuucuccucaaccgagaaaaauugcugcguacgacaacuauacaucgacuuccgcaaagaccucggauggaaguggauccacgaacccaaaggauaccacgccaacuucugccucggccccugccccuacaucuggucccucgacacacaauacuccaaaguucucgcccucuacaaccaacacaaucccggcgcaucagcagcccccugcugcgucccccaagcccuagaaccccucccaaucgucuacuacgucggccgaaaaccaaaagucgaacaauuauccaacaugaucguccgcagcugcaaaugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7048 - RNA, 1521 nt, Artificial Sequence
  mRNA product Design5 comprising derived and/or modified sequence from Homo sapiens__NP_003229.1__HsTGFB2 (opt8)
gggagagucccgcagucggcguccagcggcucugcuuguucgugugugugucguugcaggccuuauucaagcuuaccaugcacuacugcguacucuccgcauuccucauacuccaccucgucaccgucgccuuaucuuuauccacaugcucaacccucgacauggaccaauucaugcgcaaacgcaucgaagccauccgaggacaaaucuuaucaaaacucaaacuaaccuccccacccgaagacuaccccgaaccagaagaagucccacccgaagucauuuccauuuacaacuccacacgcgaccugcuacaagaaaaagccucccgccgcgccgccgcaugcgaacgcgaacgcucagacgaagaauacuacgccaaagaagucuacaaaaucgacaugccacccuucuuccccuccgaaaacgccaucccacccaccuucuacagacccuacuuccguaucguccgcuuugacgucagcgcaauggagaaaaacgccaguaaccuugucaaagccgaguuccgaguauuccgccuacaaaacccaaaagcccgcgucccagaacaacgcaucgaacucuaccaaauccuaaaauccaaagaccuaacuucucccacccaacgauacauagacucaaaaguugucaagacccgcgcagaaggugaauggcucagcuucgacguaacugacgccguccacgaauggcuacaccauaaagaccgaaaccuaggcuucaaaauaagccuccacugcccaugcugcacauucguccccucgaacaacuauaucaucccgaacaaaucagaggaacuggaagcccgcuucgccggaaucgacggaaccuccaccuacaccuccggcgaccagaaaaccauuaaaucaacccgcaaaaagaacagcggaaaaaccccacaccuccuacucaugcuacuaccauccuaccgacuagaaucacaacaaaccaaccgcagaaagaaacgcgcccucgaugccgccuacugcuucaggaacguccaagacaacugcugccuacgcccccuauacaucgacuucaaacgcgaccucggauggaaauggauccacgaaccuaaaggcuacaacgcaaacuucugcgccggagcaugccccuaccucuggagcuccgacacacaacacucucgcguccucucccuauacaacaccaucaaccccgaagccuccgccucacccugcugcgucucccaagaccucgaaccccucacaauacuauacuacaucggcaaaacccccaaaaucgaacaacuguccaacaugaucgucaaauccugcaaaugcagcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7049 - RNA, 1515 nt, Artificial Sequence
  mRNA product Design5 comprising derived and/or modified sequence from Homo sapiens__NP_003230.1__HsTGFB3 (opt8)
gggagagucccgcagucggcguccagcggcucugcuuguucgugugugugucguugcaggccuuauucaagcuuaccaugaagaugcaccuccaacgcgcccucguaguccucgcccuccucaacuucgccacagucagccucucccuaucaaccugcaccacccuagacuucggccacaucaaaaagaaaagagucgaagccauccgcggccaaauccucuccaaacuccgucucaccagcccacccgaacccaccgucaugacccacgucccauaccaaguccucgcccuauacaacuccacgcgcgaacuacuagaagaaaugcacggagaaagagaagaaggaugcacccaagaaaacacagaaucagaauacuacgcaaaagaaauccacaaauucgacaugauccaaggacucgccgaacacaacgaacucgccgugugccccaaaggcaucaccucuaaagucuuccgauucaacgucuccucaguagagaaaaaccgcaccaaccucuucagagccgaguuccgaguccucagaguccccaaccccucuucaaaacgcaacgaacaacgcauugaacuguuccaaauccuacgaccagacgaacacaucgcuaaacaacgauacauaggaggcaaaaaccugcccacccgaggaacagcagaauggcucuccuucgacgucaccgacaccguccgcgaauggcucuuacgccgagaauccaaccuuggacuagaaaucuccauacacugccccugccacaccuuccagcccaacggagacauacucgaaaacauccacgaagucauggaaaucaaauucaaaggaguagauaacgaagacgaccacggacgcggcgaccucggccgacucaagaaacaaaaagaccaccacaacccgcaccucauacugaugaugaucccaccccaucgccucgauaaccccggccagggcggccaacggaagaaacgagcacucgacaccaacuauugcuucagaaaccucgaagaaaacugcugcgucagaccccucuacaucgacuuccgccaagaccuaggcuggaaauggguacacgaaccaaaaggcuacuacgccaacuucugcagcggacccugcccauaccuccgaucggcagacaccacccacucaaccguccucggccucuacaacacccuuaaccccgaagcauccgcaucccccugcugcguaccgcaagaccuagaaccccucaccauacuauacuacgucggccgaaccccaaaagucgaacaauuauccaacauggucgucaaauccugcaaaugcagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7050 - RNA, 1662 nt, Artificial Sequence
  mRNA product Design5 comprising derived and/or modified sequence from Homo sapiens__NP_001057.1__HsTNFRSF1B (opt8)
gggagagucccgcagucggcguccagcggcucugcuuguucgugugugugucguugcaggccuuauucaagcuuaccauggcaccaguagccgucugggccgccuuggccguuggccuagaacucugggccgcagcccacgcccugccagcccaagucgcauucaccccuuacgcccccgaacccggcagcacaugccgacuccgcgaauacuacgaccaaacggcacagaugugcugcucuaaaugcagcccaggccaacacgcaaaagucuucuguacaaaaaccagcgacaccguaugcgacuccugcgaagacuccacuuauacccaacucuggaacuggguccccgaaugccucucuugcggcagccgcugcucauccgaucaagucgaaacccaagccuguacccgcgaacaaaacagaaucuguaccugcagacccggcugguacugcgcccucuccaaacaagaaggaugccgacuaugcgccccucuccgcaaaugccgcccaggauucggcguagcacgccccggcaccgaaaccucagacgucgucugcaaaccuugugcgcccggaacauucagcaacaccaccucauccaccgacaucugcagaccccaucaaauaugcaacgucgucgcuauccccggaaacgcaucaauggacgcugucugcaccucaaccucucccaccagauccauggcaccaggggccguccaccuaccccaacccgucuccacucgaucccaacacacccaacccacaccagaaccguccaccgccccauccaccuccuuccuccuccccaugggcccauccccgcccgccgaagguucuaccggagacuucgcccuucccgucggccuuaucgucggugucaccgcacucggacuccucaucauaggcgucgucaacugcgucaucaugacacaaguaaagaagaaaccacuuugccuacaacgagaagccaaaguaccccaccuccccgcagacaaagcccguggcacccaaggacccgagcaacaacaccuccuaauaaccgcccccucauccuccuccucaucacucgaaucauccgccucagcacucgaccgcagagcgcccacccgcaaccaaccacaagcccccgguguagaagccuccggcgcuggcgaagcccgcgccuccacaggaucuuccgacucuucacccggcggccacggcacccaagucaacguaaccugcauagucaacguaugcuccuccuccgaccacuccucacaaugcaguucccaagcaucaucaacaaugggagacacagacuccucccccuccgaauccccaaaagacgaacaagucccauuuucaaaagaagaaugugccuucagaucccaacucgaaacaccagaaacccuacuuggcuccacagaagaaaaaccccucccccuaggcguucccgacgcuggcaugaaaccauccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7051 - RNA, 789 nt, Artificial Sequence
  mRNA product Design5 comprising derived and/or modified sequence from Homo sapiens__NP_002623.2__HsPGF (opt8)
gggagagucccgcagucggcguccagcggcucugcuuguucgugugugugucguugcaggccuuauucaagcuuaccaugccggucaugagauuguucccgugcuuucuccagcuauuggccggguuagcacuaccggcagugcccccacaacagugggcgcucucggccgggaacgggagcucggaaguggaagugguaccauuccaggaagugugggggcgcucguacugucgagcgcucgagcgauugguagaugucgugagcgaguacccaagcgagguagagcacauguucucacccucaugcgugagcuugcucaggugcacgggcuguugcggggacgagaacuugcacugugucccgguagagaccgcgaacgugaccaugcaacugcucaagaucagaagcggggacaggcccucguacguggaauugaccuuuagccagcacgugcgcugugaaugucgcccgcucagagaaaagaugaagcccgagcgcagacgaccgaaagggcgcgggaaaaggcgcagggaaaagcaaaggcccacggacugucacuugugcggggacgcggucccgcgcagguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7052 - RNA, 1515 nt, Artificial Sequence
  mRNA product Design5 comprising derived and/or modified sequence from Homo sapiens__NP_001020537.2__HsVEGFA (opt8)
gggagagucccgcagucggcguccagcggcucugcuuguucgugugugugucguugcaggccuuauucaagcuuaccaugaccgaccgccagaccgacaccgcgcccucgccaucauaccaucucuugcccggacgcaggagaacagucgaugccgcggcaucgcgagggcaaggaccagagcccgcaccaggaggaggggucgaggggguaggagcgcgcggaguagcgcucaaacuguucguacaacugcuaggcugcaguagguucgggggagcggucguacgcgcgggggaggccgaaccaagcggcgcggccagaagcgcaagcagcggcagggaagaaccacagcccgaggaaggagaagaggaagaggaaaaagaagaggaaaggggcccacaguggcgacugggagcgcgcaagcccgggagcuggaccggagaagcggcagugugcgcggacucggccccggcagcacgcgcgccacaggcccuggccagagccucaggcaggggcgggcgcguggccaggcgcggggcagaagaaucaggaccgccccacagcccaagcaggcgagggagcgcaaguagggccgggcccggccgcgcgagcgaaaccaugaacuuccuccugagcuggguccacuggucgcucgcgcuauugcucuaccuccaccacgcgaaauggagccaggccgcgcccauggcagaaggaggcgggcagaaccaccacgagguagugaaauucauggacguauaccaaaggagcuacugccaccccauagaaacgcuuguggacauauuccaagaauaccccgacgaaaucgaauacauauucaaaccgagcugcgucccacucaugcgcugcggagggugcugcaacgacgaagggcucgaaugcgugcccacggaagagagcaauaucacgaugcaaaucaugcgcauaaaaccgcaccaggggcaacacauaggggagaugucguuccuacaacacaacaaaugcgaaugccgacccaagaaagaucgagcacgccaggaaaagaaaucagucaggggcaaaggaaagggccagaaaagaaaaagaaagaaaagccgguacaaaagcuggagcguauacgugggcgcgcgaugcugccuaaugccguggagccuaccgggaccgcacccaugcggacccugcagcgagagaagaaaacaccuauucguacaggacccgcagacaugcaaaugcucgugcaagaacacagauucgcgaugcaaagcacgacagcucgagcucaaugaaaggacaugcagaugugacaaaccccgacgcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7053 - RNA, 975 nt, Artificial Sequence
  mRNA product Design5 comprising derived and/or modified sequence from Homo sapiens__NP_001165094.1__HsVEGFA (opt8)
gggagagucccgcagucggcguccagcggcucugcuuguucgugugugugucguugcaggccuuauucaagcuuaccaugaacuuccuccucuccuggguccacuggucccuagcccuccuacuauaccuccaccacgccaaauggagccaagccgcccccauggccgagggcggcggacaaaaccaccacgaagucguaaaauucauggacguauaccaacgaagcuacugccaccccaucgaaacccucguagacauauuccaagaauaccccgacgaaaucgaauacaucuucaaaccaagcugcguaccccuaaugcgaugcggcggcugcugcaacgacgaaggccucgaaugcguacccaccgaagaaagcaacaucacaaugcaaaucaugagaaucaaaccccaccaaggccaacacauaggcgaaauguccuuccuccaacacaacaagugcgaaugccgccccaaaaaagaccgcgcccgccaagaaaagaaauccguccguggaaaaggcaaaggccaaaaacgaaaacgaaaaaaaagccgcuacaaauccuggagcgucuacguaggcgcccgaugcugccuaaugccauggucccuccccggcccccaccccugcggccccugcuccgaacgccgaaaacaccucuucguccaagacccacaaaccugcaaaugcuccugcaaaaacacagacucacgcugcaaagcaagacaacucgaacuaaacgaacgcaccugccgcugugacaaaccacgacgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7054 - RNA, 900 nt, Artificial Sequence
  mRNA product Design5 comprising derived and/or modified sequence from Homo sapiens__NP_003368.1__HsVEGFB (opt8)
gggagagucccgcagucggcguccagcggcucugcuuguucgugugugugucguugcaggccuuauucaagcuuaccaugucaccacuacuccgccgacuacuccucgccgcccuccuccaacucgcccccgcccaagcccccgucagccaacccgacgccccaggccaccaacgcaaagucgucuccuggaucgacguuuacacucgcgcaacaugccaaccccgcgaaguagucgucccacucaccgucgaacuaaugggcaccgucgccaaacaacucguccccucaugcgucaccguccaacgcugcggaggaugcugccccgacgacggccuagaaugcgucccaaccggccaacaccaaguacgcaugcaaauacucaugauccgauaccccucaucccaacuaggcgagaugucccucgaagaacacucccaaugcgaaugccgacccaaaaaaaaagacuccgccgucaaacccgaccgagccgccacaccccaccaccgcccacaaccccgcuccgucccaggcugggacucagcccccggcgcaccaucacccgccgacaucacccaccccacacccgcacccggccccuccgcccacgccgcccccucaaccaccuccgcacuaacccccggccccgccgccgccgccgccgacgccgccgcaucaucaguagcaaaaggcggagcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7055 - RNA, 1536 nt, Artificial Sequence
  mRNA product Design5 comprising derived and/or modified sequence from Homo sapiens__NP_005420.1__HsVEGFC (opt8)
gggagagucccgcagucggcguccagcggcucugcuuguucgugugugugucguugcaggccuuauucaagcuuaccaugcaccuccucggauucuucucaguagccugcucccuucuggccgcagcccuccuccccggcccgcgcgaagcccccgccgccgccgcagccuucgaauccggccuagaccugagcgacgccgagcccgacgcaggagaagccaccgccuaugccuccaaagaccucgaagaacaauugcgcucggucucgucagucgacgaacucaugaccguccucuacccagaauacuggaaaauguauaaaugccaacuccgcaaagguggcuggcaacacaaccgggaacaagccaaccucaacagccgaacagaagaaacaaucaaauucgccgcagcccacuacaacacagaaauccucaaauccauagacaacgaauggcgcaaaacccaaugcaugccccgcgaagugugcaucgacguaggcaaagaguucggcgucgccacaaacacauucuucaaaccaccgugcgucuccgucuaccgcuguggcggaugcugcaacucggaaggacuacaaugcaugaacacguccaccuccuaccucuccaaaacccucuucgaaauaaccguaccacuaucccaggguccaaaacccguaacaauauccuucgcaaaccauacuuccugccgaugcauguccaaacuugacgucuacagacagguacacagcauaauccggcguucccuacccgcuacccuaccacaaugccaagcagccaauaaaaccuguccaacaaacuacauguggaacaaccacaucugucgcugccucgcccaagaagacuucauguucuccucagacgccggcgacgacucaacagacggcuuccacgacaucuguggcccaaacaaagaacuugaugaagaaacaugccaaugcgucugccgagccggacuccgacccgcaagcugcggcccccauaaagaacuagaccggaacucaugccaaugcguauguaaaaauaaacuauuccccucccaaugcggcgccaaccgggaguucgacgaaaauaccugccaaugcguaugcaaacgcacuugcccacgcaaccaaccccuaaaccccggcaaaugcgccugcgaaugcaccgaaucgccccaaaaaugccuacucaaaggcaagaaauuccaccaccaaaccugcuccuguuaccgccgacccugcaccaaccgccaaaaagccugcgaacccgguuucucauacucagaagaggucugccgaugcguccccagcuauuggaaacgcccacaaauguccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7056 - RNA, 1341 nt, Artificial Sequence
  mRNA product Design5 comprising derived and/or modified sequence from Homo sapiens__NP_004460.1__HsVEGFD (opt8)
gggagagucccgcagucggcguccagcggcucugcuuguucgugugugugucguugcaggccuuauucaagcuuaccauguaccgugaaugggucgucgucaacguauucaugaugcuauacguucaacucguccaaggauccucaaaugaacacggcccagucaaacgcagcucccaauccacacucgaacgcuccgaacaacaaauccgcgccgccuccucccucgaagaacuacuucgcaucacccauucagaagacuggaaacuauggcgaugccgccuccgccucaaaucauuuaccucaauggacagccgcucagccucccaccgcuccacacgcuucgcggccacuuuuuacgacauagaaaccuuaaaagucauagaugaagaauggcaacgcacacaaugcucccccagagaaaccugcgucgaagucgccuccgaacucggcaaaucaaccaacaccuucuucaaacccccaugcgucaacguauuccguugcggaggcugcugcaacgaggaaucauuaaucugcaugaacacaagcacauccuacaucuccaaacaacucuucgaaaucucuguaccccucaccuccguccccgaauuaguaccugucaaagucgcaaaccacacaggaugcaagugccucccuaccgcaccccgccaccccuacuccauaauccggcgauccauccaaauccccgaagaagaccgaugcucacacucaaagaaacucugccccaucgacaugcucugggacuccaacaaaugcaaaugcguccuccaagaagaaaacccccuagccggcaccgaggaccacucccaccuacaagaaccagcccucugcggcccccacaugauguucgacgaagaccgaugcgaaugcgucugcaaaacccccugccccaaagaccucauccaacaccccaaaaacugcuccugcuucgaaugcaaagaaucccuagaaaccugcugccaaaaacacaaacuauuccacccagauaccugcucaugcgaagaccgcugccccuuccacacacgccccugcgccuccggcaaaaccgccugcgccaaacacugccgauuccccaaagaaaaacgcgccgcccaaggaccccacucccgcaaaaaccccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7057 - RNA, 906 nt, Artificial Sequence
  mRNA product Design5 comprising derived and/or modified sequence from Homo sapiens__NP_061986.1__HsFGF21 (opt9)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7058 - RNA, 1686 nt, Artificial Sequence
  mRNA product Design5 comprising derived and/or modified sequence from Homo sapiens__NP_002412.1__HsMMP1 (opt9)
gggagagucccgcagucggcguccagcggcucugcuuguucgugugugugucguugcaggccuuauucaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7059 - RNA, 1446 nt, Artificial Sequence
  mRNA product Design5 comprising derived and/or modified sequence from Homo sapiens__NP_002412.1__HsMMP1(1-19,100-469) (opt9)
gggagagucccgcagucggcguccagcggcucugcuuguucgugugugugucguugcaggccuuauucaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7060 - RNA, 3633 nt, Artificial Sequence
  mRNA product Design5 comprising derived and/or modified sequence from Clostridium histolyticum__BAA77453.1__ColG (opt9)
gggagagucccgcagucggcguccagcggcucugcuuguucgugugugugucguugcaggccuuauucaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7061 - RNA, 3357 nt, Artificial Sequence
  mRNA product Design5 comprising derived and/or modified sequence from Clostridium histolyticum__BAA77453.1__HsALB(1-18)_ColG(111-1118) (opt9)
gggagagucccgcagucggcguccagcggcucugcuuguucgugugugugucguugcaggccuuauucaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7062 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt9)
gggagagucccgcagucggcguccagcggcucugcuuguucgugugugugucguugcaggccuuauucaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7063 - RNA, 3381 nt, Artificial Sequence
  mRNA product Design5 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7064 - RNA, 3342 nt, Artificial Sequence
  mRNA product Design5 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7065 - RNA, 3276 nt, Artificial Sequence
  mRNA product Design5 comprising derived and/or modified sequence from Clostridium histolyticum__BAA34542.1__HsALB(1-18)_ColH(41-1021) (opt9)
gggagagucccgcagucggcguccagcggcucugcuuguucgugugugugucguugcaggccuuauucaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7066 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt9)
gggagagucccgcagucggcguccagcggcucugcuuguucgugugugugucguugcaggccuuauucaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7067 - RNA, 852 nt, Artificial Sequence
  mRNA product Design5 comprising derived and/or modified sequence from Homo sapiens__NP_001133.1__HsAMELX (opt9)
gggagagucccgcagucggcguccagcggcucugcuuguucgugugugugucguugcaggccuuauucaagcuuaccaugggaacauggauacucuucgcaugccuccucggcgcagccuucgccaugccccucccuccccaccccggccaccccggcuacaucaacuucuccuacgaaguccucacaccccucaaaugguaucaauccaucagaccacccuaccccuccuacggcuacgaacccaugggcggcuggcuccaccaccaaaucauccccguccucucacaacaacacccucccacccacacccuccaaccccaccaccacauccccguaguccccgcccaacaacccgucaucccccaacaacccaugaugcccguccccggccaacacucaaugacccccauccaacaccaccaacccaaccucccaccacccgcccaacaacccuaccaaccccaacccguccaaccccaaccccaccaacccaugcaaccccaaccacccguacaccccaugcaaccccucccaccccaaccaccccuaccucccauguuccccaugcaaccccucccacccaugcuccccgaccucacccucgaagccuggcccuccaccgacaaaaccaaacgcgaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7068 - RNA, 411 nt, Artificial Sequence
  mRNA product Design5 comprising derived and/or modified sequence from Homo sapiens__NP_001133.1__HsAMELX-TRAP (opt9)
gggagagucccgcagucggcguccagcggcucugcuuguucgugugugugucguugcaggccuuauucaagcuuaccaugccccuacccccccacccaggccaccccggcuacauaaacuucuccuacgaaguacucacaccccuaaaaugguaccaauccauccgaccccccuaccccucauacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7069 - RNA, 444 nt, Artificial Sequence
  mRNA product Design5 comprising derived and/or modified sequence from Homo sapiens__NP_001133.1__HsAMELX-LRAP (opt9)
gggagagucccgcagucggcguccagcggcucugcuuguucgugugugugucguugcaggccuuauucaagcuuaccaugccccuccccccccaccccggccaccccggcuacauaaacuucucauacgaaguccucaccccccuaaaaugguaccaauccauccgccccccccccaugcuccccgaccucacacucgaagccuggcccucaaccgacaaaacaaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7070 - RNA, 483 nt, Artificial Sequence
  mRNA product Design5 comprising derived and/or modified sequence from Homo sapiens__NP_001133.1__HLA-A2-SP_HsAMELX(17-60) (opt9)
gggagagucccgcagucggcguccagcggcucugcuuguucgugugugugucguugcaggccuuauucaagcuuaccauggccguaauggccccccgaacccucguccuccuacucucaggagcccucgcccucacccaaaccugggccaugccccucccaccccacccaggccaccccggauacaucaacuucuccuacgaaguacucaccccccuaaaaugguaccaauccauccgcccccccuaccccucauacggcuacgaacccaugggcggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7071 - RNA, 516 nt, Artificial Sequence
  mRNA product Design5 comprising derived and/or modified sequence from Homo sapiens__NP_001133.1__HLA-A2-SP_HsAMELX(17-47,168-191) (opt9)
gggagagucccgcagucggcguccagcggcucugcuuguucgugugugugucguugcaggccuuauucaagcuuaccauggccguaauggcaccccgcacccucguccuacuccuauccggcgcccucgcccucacacaaaccugggccaugccccucccaccccaccccggccaccccggcuacauaaacuucuccuacgaaguccucaccccacucaaaugguaccaauccauccgcccaccacccaugcuacccgaccucacacucgaagccuggcccuccaccgacaaaacaaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7072 - RNA, 855 nt, Artificial Sequence
  mRNA product Design5 comprising derived and/or modified sequence from Homo sapiens__NP_001134.1__HsAMELY (opt9)
gggagagucccgcagucggcguccagcggcucugcuuguucgugugugugucguugcaggccuuauucaagcuuaccaugggcaccuggauccucuucgccugccuagucggcgccgccuucgccaugccccucccaccccaccccggccaccccggcuacaucaacuucuccuacgaaguccuaacaccccuaaaaugguaccaauccaugauccgcccacccuacuccuccuacggcuacgaacccaugggcggauggcuccaccaccaaaucauccccgucgucucccaacaacacccccucacccacacccuccaaucacaccaccacauccccguaguccccgcccaacaaccccgcguacgacaacaagcccucaugcccguccccggccaacaauccaugacccccacccaacaccaccaacccaaccucccacuccccgcacaacaacccuuccaaccccaacccguccaaccccaaccccaccaaccaaugcaaccccaaccacccguccaacccaugcaaccccucuuaccccaaccaccccuaccacccauguucccccuccgcccccuaccacccauccuccccgaccuccaccucgaagccuggcccgccaccgacaaaacaaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7073 - RNA, 414 nt, Artificial Sequence
  mRNA product Design5 comprising derived and/or modified sequence from Homo sapiens__NP_001134.1__HsAMELY-TRAP (opt9)
gggagagucccgcagucggcguccagcggcucugcuuguucgugugugugucguugcaggccuuauucaagcuuaccaugccccuaccaccccacccaggccaccccggcuacaucaacuucucauacgaaguccucaccccccuaaaaugguaccaaucaaugauccgccccccauacucauccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7074 - RNA, 447 nt, Artificial Sequence
  mRNA product Design5 comprising derived and/or modified sequence from Homo sapiens__NP_001134.1__HsAMELY-LRAP (opt9)
gggagagucccgcagucggcguccagcggcucugcuuguucgugugugugucguugcaggccuuauucaagcuuaccaugccccuccccccccacccaggccaccccggcuacaucaacuucuccuacgaaguacucaccccccuaaaaugguaccaauccaugauccgccccccccccauacuccccgaccuccaccucgaagccuggcccgccacagacaaaaccaaacaagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7075 - RNA, 486 nt, Artificial Sequence
  mRNA product Design5 comprising derived and/or modified sequence from Homo sapiens__NP_001134.1__HLA-A2-SP_HsAMELY(17-61) (opt9)
gggagagucccgcagucggcguccagcggcucugcuuguucgugugugugucguugcaggccuuauucaagcuuaccauggcagucauggcaccccgcacccucguccuccuccucuccggcgcccucgcccuaacccaaaccugggcaaugccacuacccccacaccccggccaccccggcuacaucaacuucucauacgaaguccuaacaccccucaaaugguaccaaucaaugauccgcccacccuacuccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7076 - RNA, 519 nt, Artificial Sequence
  mRNA product Design5 comprising derived and/or modified sequence from Homo sapiens__NP_001134.1__HLA-A2-SP_HsAMELY(17-48,169-192) (opt9)
gggagagucccgcagucggcguccagcggcucugcuuguucgugugugugucguugcaggccuuauucaagcuuaccauggccgucauggcaccccgaacacucguccuccuccucuccggcgcccucgcccucacacaaacaugggccaugccccucccaccccaccccggccaccccggcuacaucaacuucuccuacgaaguccucacaccccuaaaaugguaccaauccaugauccgcccacccccaauacuccccgaccuacaccucgaagccuggcccgccaccgacaaaaccaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7077 - RNA, 846 nt, Artificial Sequence
  mRNA product Design5 comprising derived and/or modified sequence from Sus scrofa__NP_999071.1__SsAMELX-001-1 (opt9)
gggagagucccgcagucggcguccagcggcucugcuuguucgugugugugucguugcaggccuuauucaagcuuaccaugggcaccuggauacucuucgccugccuccucggcgccgccuucuccaugccccuaccaccccaccccggacaccccggcuacaucaacuucuccuacgaaguccuaacaccccucaaaugguaccaaaauaugauacgccaccccuacacauccuacggcuacgaacccaugggcggauggcuccaccaccaaaucauccccgucgucucacaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuacccgcccaacaacccuuccaaccccaacccguacaaccccaaccccaccaaccccuucaaccccaaucucccaugcaccccauccaaccccuccucccccaaccaccccuuccacccauguucucaaugcaaucacuccuccccgaccucccccucgaagccuggcccgccaccgacaaaaccaaacgagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7078 - RNA, 414 nt, Artificial Sequence
  mRNA product Design5 comprising derived and/or modified sequence from Sus scrofa__NP_999071.1__SsAMELX-TRAP (opt9)
gggagagucccgcagucggcguccagcggcucugcuuguucgugugugugucguugcaggccuuauucaagcuuaccaugccccuaccaccccaccccggccaccccggcuacaucaacuucuccuacgaaguccuaacaccccuaaaaugguaccaaaacaugauccgccacccauacaccucauacggcuacgaaccaaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7079 - RNA, 447 nt, Artificial Sequence
  mRNA product Design5 comprising derived and/or modified sequence from Sus scrofa__NP_999071.1__SsAMELX-LRAP (opt9)
gggagagucccgcagucggcguccagcggcucugcuuguucgugugugugucguugcaggccuuauucaagcuuaccaugccccucccaccccaccccggccaccccggcuacaucaacuucuccuacgaaguccuaacaccccucaaaugguaccaaaacaugauccgacaccccucccuacuccccgaccucccccuagaagcauggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7080 - RNA, 486 nt, Artificial Sequence
  mRNA product Design5 comprising derived and/or modified sequence from Sus scrofa__NP_999071.1__HLA-A2-SP_SsAMEL(17-61) (opt9)
gggagagucccgcagucggcguccagcggcucugcuuguucgugugugugucguugcaggccuuauucaagcuuaccauggccgucauggcaccccgcacccuaguccuccuccucucaggcgcccucgcacucacccaaacaugggccaugccccuacccccacaccccggccacccaggcuacaucaacuucucauacgaaguccucaccccacuaaaaugguaccaaaacaugauacgccaccccuacaccucauacggauacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7081 - RNA, 519 nt, Artificial Sequence
  mRNA product Design5 comprising derived and/or modified sequence from Sus scrofa__NP_999071.1__HLA-A2-SP_SsAMEL(17-49,167-189) (opt9)
gggagagucccgcagucggcguccagcggcucugcuuguucgugugugugucguugcaggccuuauucaagcuuaccauggccgucauggcaccccgcacucucguccuccuacucuccggcgcccuagcccucacccaaaccugggccaugccccuacccccacaccccggccaccccggcuacaucaacuucucauacgaaguccucaccccacuaaaaugguaccaaaacaugauccgccaucccucacuccuccccgaccucccccuagaagccuggcccgccacagacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7082 - RNA, 810 nt, Artificial Sequence
  mRNA product Design5 comprising derived and/or modified sequence from Sus scrofa__P45561-2__SsAMELX-001-2 (opt9)
gggagagucccgcagucggcguccagcggcucugcuuguucgugugugugucguugcaggccuuauucaagcuuaccaugggcaccuggauacucuucgccugccuccucggcgcagccuucuccaugccccucccaccccaccccggccaccccggcuacaucaacuucucuuacauccgccaccccuacaccuccuacggcuacgaacccaugggcggcuggcuacaccaccaaaucauccccgucguaucccaacaaaccccacaaucacacgcucuccaaccccaccaccacauccccaugguccccgcccaacaacccggcaucccccaacaacccaugaugccccuccccggccaacacuccaugacccccacccaacaccaccaacccaaccucccccucccagcccaacaacccuuccaaccccaacccguccaaccccaaccacaccaaccacuacaaccacaaucccccaugcaccccauccaaccacuccucccccaaccaccccucccacccauguucucaaugcaaucccuccuacccgaccuuccccuugaagccuggcccgccaccgacaaaaccaaacgagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7083 - RNA, 846 nt, Artificial Sequence
  mRNA product Design5 comprising derived and/or modified sequence from Sus scrofa__NP_998965.1__SsAMELX-001-3 (opt9)
gggagagucccgcagucggcguccagcggcucugcuuguucgugugugugucguugcaggccuuauucaagcuuaccaugggcaccuggaucuucuucgcaugccuccuaggcgccucccucgccaugccccucccaccccaccccggacaccccggcuacaucaacuucuccuacgaaguccucaccccacuaaaaugguaccaaaacaugauccgccaccccuacaccuccuacggauacgaacccaugggaggcuggcuccaccaccaaaucauccccgucgucucacaacaaacaccccaaucccacgcacuccaaccccaccaccacauccccaugguccccgcccaacaacccggaaucccccaacaacccaugaugccccuccccggacaacacuccaugacccccacccaacaccaccaaccaaaccucccccuccccgcccaacaacccuuccaaccacaacccguccaaccccaaccccaccaaccacuccaaccccaaucccccaugcaccccauccaaccacuccucccccaaccaccccucccacccauguucucaaugcaaucccuccuucccgaccucccccucgaagccuggcccgccaccgacaaaaccaaacgcgaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7084 - RNA, 495 nt, Artificial Sequence
  mRNA product Design5 comprising derived and/or modified sequence from Sus scrofa__K7GPB2__SsAMELX-002 (opt9)
gggagagucccgcagucggcguccagcggcucugcuuguucgugugugugucguugcaggccuuauucaagcuuaccaugggcaccuggauacucuucgccugccuacucggcgccgcauucucaaugccccuccccccccaccccggccaccccggcuacauaaacuucuccuacgaaguccucaccccccucaaaugguaccaaaacaugauuagacacccaucccuccuccccgaccucccccucgaagcauggcccgcaaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7085 - RNA, 888 nt, Artificial Sequence
  mRNA product Design5 comprising derived and/or modified sequence from Sus scrofa__K7GLD0__SsAMELX-003 (opt9)
gggagagucccgcagucggcguccagcggcucugcuuguucgugugugugucguugcaggccuuauucaagcuuaccaugggcacauggauccucuucgccugccuacucggagccgcuuuuuccaugccccucccuccccaccccggccaccccggcuacauaaacuucuccuacgaagaccucuaccucgaagccauccgcaucgaccgcaccgccuucguccucacaccccuuaaaugguaccaaaacaugauccgccaccccuacaccuccuacggcuacgaacccaugggcgguuggcuccaccaccaaaucauccccguagucucacaacaaaccccacaaucccacgcccuccaaccccaccaccacauaccaaugguccccgcccaacaaccaggcaucccccaacaacccaugaugccccuccccggccaacacuccaugaccccaacccaacaccaccaacccaaccucccccuccccgcccaacaacccuuccaaccccaacccguccaaccccaaccccaccaaccccuccaaccccaaucccccaugcaccccauccaaccucuccucccccaacccccacucccaccaauguucucaaugcaaucacuccuccccgacuuaccccuagaagccuggcccgccaccgacaaaaccaaacgagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7086 - RNA, 774 nt, Artificial Sequence
  mRNA product Design5 comprising derived and/or modified sequence from Sus scrofa__K7GPE9__SsAMELX-004 (opt9)
gggagagucccgcagucggcguccagcggcucugcuuguucgugugugugucguugcaggccuuauucaagcuuaccaugggcaccuggauccucuucgccugccuccucggcgccgccuucuccaugccccucccaccccaccccggccaccccggcuacaucaacuucucauaugaaguccucacaccccucaaaugguaccaaaacaugauccgccaccccacaccccaaucccacgcccuccaaccacaccaccacauccccaugguccccgcccaacaaccaggcaucccacaacaacccaugaugccccuaccaggccaacacuccaugacccccacccaacaccaccaacccaaccuaccccuccccgcacaacaacccuuccaaccacaacccguccaaccccaaccccaccaaccccuacaaccccaaucccccaugcacccaauccaaccccuccucccccaaccaccccucccacccauguucuccaugcaaucacuccuccccgaccucccccuagaagccuggcccgcaaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7087 - RNA, 798 nt, Artificial Sequence
  mRNA product Design5 comprising derived and/or modified sequence from Sus scrofa__J9JIM4__SsAMELX-201 (opt9)
gggagagucccgcagucggcguccagcggcucugcuuguucgugugugugucguugcaggccuuauucaagcuuaccaugccccucccaccccaccccggccaccccggcuacaucaacuucuccuacgaaguacucaccccucucaaaugguaccaaaacaugauccgacaccccuacaccuccuacggcuacgaacccaugggcggcuggcuccaccaccaaaucauccccgucgucucccaacaaacaccccaaucccacgcacuacaaccccaccaccacauccccaugguccccgcccaacaacccggcaucccccaacaacccaugaugccacuccccggccaacacuccaugacccccacccaacaccaccaacccaaccucccccuacccgcccaacaacccuuccaaccccaacccguccaaccacaaccucaccaaccacuccaaccccaaucacccaugcaccccauccaaccacuccuaccccaacccccacucccacccauguucuccaugcaaucacuccuccccgaccucccccuagaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7088 - RNA, 3237 nt, Artificial Sequence
  mRNA product Design5 comprising derived and/or modified sequence from Homo sapiens__NP_006120.1__HsBMP1 (opt9)
gggagagucccgcagucggcguccagcggcucugcuuguucgugugugugucguugcaggccuuauucaagcuuaccaugccaggagucgcccggcuaccccuacuccuaggacuccuccuacuaccacgcccuggacgaccccuagaccuggccgacuacacguacgaccuagccgaagaagacgacuccgaaccccucaacuacaaagaccccugcaaggccgccgccuuccuaggcgacauagcccuagacgaagaagaccuccgagccuuccaaguccaacaagcggucgaccugcgccgacacacggccaggaaaucauccauaaaagccgcuguaccgggaaacacaucaacccccucaugccaaucgacaaacggacaaccacaaaggggcgcaugcggaagauggcgcgggcgaucacgcucacgccgcgcagccacaagccgcccggagcgaguguggcccgacgggguaauacccuucgucauagggggaaacuucacuggaucacaacgggcagucuuuagacaagcaaugagacacugggaaaagcauaccugcgucacauuccuagaacggaccgacgaagauucauacaucguauucaccuaccgcccaugcggauguugcucauacguaggccgaagaggcggcggcccccaagcgauaucgauaggcaagaacugcgacaaauucgggauaguuguacacgaacuaggacacgucguaggcuucuggcacgaacacaccagacccgaccgggaccggcacguauccauaguccgcgaaaacauccaacccggacaagaauacaacuuccuaaaaauggaaccacaagaagucgaaucgcuaggcgaaaccuaugacuucgauuccaucaugcacuaugcucgcaacaccuucucacgaggcaucuuccucgacaccaucguccccaaauacgaaguuaacggagucaaaccacccauaggacaacgcacgcgacucucaaaaggcgauaucgcucaagcacgcaaacucuacaagugucccgccugcggcgaaacgcuccaggacucgacaggcaacuucucaucccccgaauacccgaacggauacagcgcacacaugcacugugucuggcgaaucucaguaacaccaggcgagaaaaucauccuuaacuucacaucccucgaccuguacagaucccgccucugcugguacgauuacgucgaagucagagacggguucuggcgaaaagcaccgcuccgaggccgauucuguggauccaaacugccagaacccauagucuccacagacucucgacucuggguugaguucagaagcucuaguaacugggucggcaaaggcuucuucgccgucuacgaagcaaucugcggaggagacguaaagaaagauuacggccacauacagucccccaacuaccccgacgacuaccggcccaguaaaguauguaucuggagaauccagguaagcgaaggcuuccauguugggcucaccuuucagagcuucgaaauagaacgccacgacucaugcgcuuaugacuaucucgaaguacgcgacggccacuccgaaucaagcacacucauaggcagauacugcggauacgaaaaacccgaugacaucaaauccacguccagccgccuauggcucaaauucgucucagauggaagcauaaacaaagccggauuugcuguuaacuucuucaaggaaguagacgagugcucccgacccaaccgcggcgggugcgaacaacgcugccucaacacacucgguuccuacaaaugcagcugcgacccaggcuacgaacuagccccugauaagcgucgcugcgaagcagccugcgguggguuccucacaaaacuaaacggauccauaacaagcccuggcuggccaaaagaauaucccccuaacaagaacugcaucuggcaacugguggcgcccacacaauaccgaauaagccuacaauuugacuucuucgagacagaaggaaaugacgugugcaaguacgacuucguagaaguccgcuccggguuaaccgccgacuccaagcugcaugggaaauucugcggauccgaaaaaccagaagugauuacgagccaauacaacaacaugcgagucgaguucaagucagacaacacagucuccaagaaaggcuuuaaagcucacuucuucucagacaaagacgagugcucaaaagacaauggagggugucaacaagacugcguuaacacauucggguccuacgaaugccaaugccgcucuggguucguacuucacgauaacaagcacgacugcaaagaagccggaugcgaccacaaggugacaagcaccuccggcaccauaacgucccccaacuggccagauaaauaccccucaaagaaagaaugcacgugggccaucaguagcacucccggccacagagucaaacucacauucauggaaauggacaucgaaagccagccggagugcgcguacgaccaccucgaaguguucgacggacgcgacgcgaaggcuccagugcucggccgauucugcggauccaagaagccagaaccagucuuagcaacuggaagccgaauguuccuacgauucuacuccgacaauuccguucaacgaaaaggcuuccaagccucccacgccaccgaaugcggcggacaaguccgagcggacguaaaaaccaaagaccucuacagccacgcgcaauucggggacaacaacuacccagguggcguagacugcgaauggguaauagucgcagaagaaggcuacggagucgagcuaguauuccagaccuucgaaguugaagaagaaacagacugcggcuacgacuacauggaacuauucgacgguuacgacuccaccgcaccccggcucggacgguacugcggcuccggcccaccagaagaaguauacucagcaggagacagcguccucgucaaauuccacuccgaugauaccauaacaaagaaaggguuucaccuacgcuacacgagcaccaaauuccaagacacucuacacagccgcaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7089 - RNA, 1467 nt, Artificial Sequence
  mRNA product Design5 comprising derived and/or modified sequence from Homo sapiens__NP_001191.1__HsBMP2 (opt9)
gggagagucccgcagucggcguccagcggcucugcuuguucgugugugugucguugcaggccuuauucaagcuuaccaugguagccggcacccgaugccuacucgcccuccuucucccccaaguccuccuaggcggcgccgccggccuggucccagaacuaggccgccgcaaauucgcagccgcauccuccggacgcccaucaucacagcccuccgacgaaguccucuccgaguucgaacucagacuacuaucgauguucggccuuaaacaacgccccaccccaucccgugacgccguagucccaccauacaugcucgaccuauaccgccgccacuccgggcaacccggaucaccagcacccgaccaccgccucgaacgcgccgcaucccgcgccaacacaguccgcuccuuccaccacgaagaaucccucgaagaacuccccgaaacaucaggcaaaacaacccgccgauucuucuucaaccucuccuccauacccacagaagaguucaucaccuccgcagaauuacaagucuuccgcgaacaaaugcaagacgcacucggcaacaacuccuccuuccaccacagaaucaacaucuacgaaaucaucaaacccgcaaccgccaacagcaaauucccaguaacccgacuccuugacacacgacucgucaaccaaaacgccuccagaugggaaucauucgacgucacaccagcagucaugcgcuggaccgcccaaggccacgcaaaccauggauucgugguagaagucgcccaccuagaagaaaaacaaggagucuccaaacgccacguccgcaucucacgcucccuccaccaagacgaacacucauggucacaaauccgaccccuccuaguaacauucggacacgacggcaaaggccacccccuacauaaacgcgaaaaacgacaagccaaacauaagcaacgaaaacgccucaaaucaagcuguaaacgucauccacucuacgucgacuucucugacgucggcuggaacgacuggaucguagcaccacccggcuaccacgccuuuuacugccacggagaaugccccuucccccucgccgaccaccuaaauuccaccaaccacgcaauaguccaaacccuaguuaacuccgucaacuccaaaaucccaaaagcaugcugcguucccacagaacucucagcaaucuccaugcucuaccuugacgaaaacgaaaaagucguccugaaaaacuaccaagacauggucgucgaaggcugcggcugccgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7090 - RNA, 1503 nt, Artificial Sequence
  mRNA product Design5 comprising derived and/or modified sequence from Homo sapiens__NP_001193.2__HsBMP4 (opt9)
gggagagucccgcagucggcguccagcggcucugcuuguucgugugugugucguugcaggccuuauucaagcuuaccaugauacccggcaaccguaugcucauggucguccuccucugccaaguacuccucggcggagccucacacgcaucucucauacccgaaacuggcaaaaaaaaagucgccgaaauccaaggccacgcaggaggacgccgcucaggucaaucccacgaacuccuacgcgacuucgaagccacccuacuacaaauguucggccuccgacgccgaccccagcccuccaaauccgccgucauacccgacuacaugcgcgaccucuaccgacuucaauccggcgaagaagaagaagaacaaauacacagcaccggccucgaauaccccgaacguccagccucccgcgccaacaccguccgcucuuuccaccacgaagaacaccucgaaaacauccccggcacauccgaaaacuccgccuuccgauuccucuucaaccuauccucaauccccgaaaacgaagucauauccuccgccgaacuccgucucuuccgcgaacaaguagaccaaggccccgauugggaacgcggcuuccaccgcaucaauaucuacgaagucaugaaaccaccagccgaagucguacccggacaccucaucacacgcuuacuagacacccgccucguccaccacaacguaacacgcugggaaaccuucgacgucuccccagcuguucuccgauggacacgcgaaaaacaacccaacuacggccucgccaucgaagucacccaccuccaccaaacccgaacccaccaaggccaacacgucagaaucucccgcucucucccccaaggcucaggcaacugggcccaacuacgcccccuacuugucaccuucggccacgacggacgaggccacgcacuaacgcgacgccgccgcgccaaacgcucacccaaacaccacucucagcgcgccagaaaaaaaaacaaaaauugccgccgacacucacuguacgucgacuucagcgacgucggcuggaaugacuggaucgucgccccccccggcuaccaagcauucuacugccacggcgacugcccauucccacuagcugaccaccucaacucgaccaaccacgcaauuguacaaacccucgucaauuccgucaacagcuccaucccaaaagcaugcugcgugcccaccgaacucuccgcuaucuccaugcucuaccucgacgaauacgacaaagucguacucaaaaacuaccaagaaauggucgucgaaggaugcggcugccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7091 - RNA, 1818 nt, Artificial Sequence
  mRNA product Design5 comprising derived and/or modified sequence from Homo sapiens__NP_001709.1__HsBMP6 (opt9)
gggagagucccgcagucggcguccagcggcucugcuuguucgugugugugucguugcaggccuuauucaagcuuaccaugcccggucuaggccgccgcgcacaguggcucugcuggugguggggacuacucugcuccugcugcggcccuccccccuuacguccacccuuaccagcagccgccgccgcggcagcaggaggccaacuacucggcgacgguggcucccccggacgaacggaacaacccccccccucaccccaauccucaagcggcuuccucuaccgccgccucaaaacccaagaaaaacgagaaaugcaaaaagaaauacuauccguccuaggccuuccacaccggccccgcccacuccacggccugcaacaaccccagccacccgcccuccgccaacaagaagaacaacaacaacaacaacaacucccccggggugaacccccuccaggccgccuaaaaucugccccucucuucaugcucgaccucuacaaugcccuauccgccgauaacgacgaagauggagcgucagaaggagaacgccaacaaucauggccccacgaagccgccuccucaucccaacgccgacaacccccgcccggcgccgcccacccccuaaaccguaaaucccugcucgcccccggcucaggcagcgguggugcauccccacucaccucggcccaagacuccgcauuccuaaacgacgcagacauggucaugagcuucgucaaccuagucgaauacgacaaagaauucuccccacgccaacgacaccauaaagaauucaaauucaaccucucacagauacccgaaggagaagucgucaccgccgcagaauuccgaaucuacaaagacugcguaauggguagcuucaaaaaccaaacauuccuaaucucuauauaccaaguacuccaagaacaccaacaccgugacagugaccuauuccuccucgacacccgagucguuugggccucagaagaaggcuggcucgaauucgacaucacagcaaccagcaaccuauggguaguaacaccgcaacacaacaugggccuacaacuauccguagucacccgagacggaguacacguucacccgcgcgcagccggccucguaggacgcgacggccccuacgacaaacagcccuucauggucgccuucuucaaagucuccgaaguacacguccgcaccacccgcuccgccuccucucgacgccgccaacaaucccgaaaccgauccacccaaucccaagacgucgcccgcguuuccucugccucagacuacaauuccucagaacucaaaaccgccugccgaaaacacgaacuauauguaucauuccaagaccuuggcuggcaagacuggaucaucgcccccaaaggcuacgcagccaacuacugcgacggcgaaugcuccuucccacuaaacgcccacaugaacgccaccaaccacgccaucguccaaacacucgugcaccuuaugaaccccgaauacguacccaaaccaugcugcgcccccaccaaacuaaacgccaucuccguacucuacuucgaugacaacuccaacgucauacuaaaaaaauaccguaacaugguaguacgcgccugcgguugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7092 - RNA, 1572 nt, Artificial Sequence
  mRNA product Design5 comprising derived and/or modified sequence from Homo sapiens__NP_001710.1__HsBMP7 (opt9)
gggagagucccgcagucggcguccagcggcucugcuuguucgugugugugucguugcaggccuuauucaagcuuaccaugcacgugcguucacuacgagcagccgccccacacucauucgucgcccucugggcuccccuuuuucuccuacgcucugcccucgccgacuucucccuagacaacgaaguacacagcucauucauccaccgccgucuccgcucucaagaaagacgcgaaaugcaacgugaaauccucuccauccucggccucccccaccgaccccgcccccaccuacaaggcaaacacaacuccgcccccauguucaugcucgaccucuacaacgccauggccguagaagaaggaggaggacccgguggccaaggcuucuccuaccccuacaaagccgucuuuuccacccaaggucccccgcucgcaucacuccaagacucccacuuccucaccgacgccgacauggucaugucauucgucaaccuugucgaacacgacaaagaguucuuccacccccgcuaccaccaucgcgaguuccgcuucgaccucagcaaaauucccgaaggcgaagccgucaccgccgccgaguuccgaaucuacaaagacuacauccgugaacgcuucgacaacgaaacuuuccgcaucucagucuaccaaguccuccaagaacaccuaggccgcgaaucagaccucuuucuccucgacucacgaacccucugggccucagaagaaggauggcucgucuucgacaucacagccacauccaaccacugggucgucaacccucgccacaaccuuggacuccaacuguccgucgaaacccucgacggccaauccauaaaccccaaacucgccggccucauaggccgacacggaccccaaaacaaacaaccauucauggucgcauuuuucaaagcaaccgaaguccacuuuagauccauccguuccaccggaucaaaacaacgcucccaaaaccgcuccaaaacccccaaaaaccaagaagcccuccgcauggccaacguagcagaaaacuccuccagcgaccaacgccaagccugcaaaaagcacgaacucuacguaucauuucgagaccucggcuggcaagacuggauaaucgccccagaaggcuacgccgcauacuacugcgaaggagaaugcgccuucccccuaaauuccuacaugaacgccaccaaccacgccaucguccaaacccucguccacuucaucaaccccgaaacugucccaaaacccugcugcgcccccacacaacuaaacgccaucucaguccucuacuuugacgacucaucuaacguaauccuaaagaaauaucgcaacaugguaguccgcgccugcgguugccacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7093 - RNA, 576 nt, Artificial Sequence
  mRNA product Design5 comprising derived and/or modified sequence from Homo sapiens__NP_006264.2__HsCCL7 (opt9)
gggagagucccgcagucggcguccagcggcucugcuuguucgugugugugucguugcaggccuuauucaagcuuaccaugaaagccuccgccgcccuccuaugccuccuccucaccgccgccgcauucuccccccaaggccucgcccaaccagucggcauaaacaccuccaccaccugcugcuaccgauucaucaacaaaaaaaucccaaaacaacgacucgaauccuaccgccgcaccaccuccucccacugcccccgagaagccgucaucuucaaaaccaaacucgacaaagaaaucugcgccgacccaacccaaaaauggguccaagacuucaugaaacaccuagacaaaaaaacccaaaccccaaaacucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7094 - RNA, 3900 nt, Artificial Sequence
  mRNA product Design5 comprising derived and/or modified sequence from Homo sapiens__NP_001954.2__HsEGF (opt9)
gggagagucccgcagucggcguccagcggcucugcuuguucgugugugugucguugcaggccuuauucaagcuuaccaugcucuuaacccuuaucauacuucuucccgucgucagcaaguucagcuuugucucacucagugcaccccaacacuggagcugccccgaaggaacacuugccggcaacggcaauagcacaugcguugggccggcucccuuccuaauauucagccacggaaacagcauauuccgaaucgacacagagggaaccaacuacgaacagcugguagucgacgcuggcguaagcgucaucauggacuuccacuacaacgagaagcgaaucuacuggguagaucucgaacgccaacuacugcaacggguauucuugaacggcucgcgacaggagcgcgucugcaauaucgaaaagaacgucucaggaauggcuaucaacuggauuaaugaagaggugauauggagcaaccaacaggagggaaucauaaccgucacagacaugaaggguaacaacucccacauccuucucagcgcgcucaaauacccugcaaaugucgccguggauccugucgaacguuuuauauucuggucaagugaaguagccggcucccucuacagagccgaccucgacgguguaggggucaaggcacuacucgaaacguccgagaaaauaacagcaguaucgcuggacguacucgacaaacgccuauucuggauucaguacaaccgagaaggcagcaacuccuuaaucugcaguugcgacuacgacggagguagcgugcauauaaguaaacacccaacgcagcacaaccuauuugccaugucacuguucggggaccgcaucuucuacagcaccuggaaaaugaaaacaauauggaucgcaaacaaacacaccggcaaggauaugguccgcaucaaccuacacucuucauucguaccccuaggggagcucaaaguagugcacccucucgcccaaccaaaagcagaggaugauaccugggaacccgaacaaaagcugugcaaacuccgaaagggcaacugcucgagcaccgucugcggacaagaccugcaaagccaccucugcaugugugcggaaggauacgcacucucacgagaccggaaguacugcgaggacgucaacgaaugcgccuucuggaaccacggaugcacucuuggauguaagaacaccccaggauccuauuacuguaccugcccagucggauucguacuacuaccagacggaaaacgaugccaccaacugguauccugcccccgaaacguauccgaaugcucccacgauugcguccuaaccucagaggggccccucugcuucugcccagagggauccguguuagaacgcgacggcaagacuugcagcggcugcagcagcccagacaacggcgggugcagccaacuaugcguaccacuaucaccaguuucaugggaaugcgacugcuucccggguuacgaccuccagcucgacgaaaaaucaugugcggccagcggaccacagcccuuccuccuauucgccaauucacaagacauccggcacaugcacuucgacggcaccgacuacgguacccuacugagccaacaaauggguaugguguacgcgcucgaccacgacccaguagaaaacaaaauauacuucgcccacacagcccucaaguggaucgaacgagccaacauggauggaucacaacgcgagcggcuaauagaggaagguguggacgugccagaaggccuggccguagacuggauaggccgcagauucuauuggacagacagagguaaaucacucaucggacgaucagaccucaacggcaaaagguccaaaaucaucacuaaagagaacauaucacaaccacgcggcauagccguccaccccauggccaaacgccucuucuggaccgacacgggcaucaacccaagaauagaguccagcagccuccagggccuaggaagacuuguaaucgcaucguccgaucucauuuggcccagcgggaucacaaucgauuuccuaacugacaaacucuacuggugcgacgccaaacaaaguguaaucgaaauggcaaaccucgacggaucgaaacgacggcgccucacccaaaacgauguuggccaucccuucgcaguagcagucuuugaggacuacgucugguucagcgacugggccaugcccuccguaaugcggguuaacaaacgcaccggcaaagaccgaguccgacuacaggguuccaugcuuaaaccgagcucccuaguuguaguacacccacuagcaaaacccggggccgaccccugcuuauaucaaaacggaggaugcgaacacaucugcaagaaacgccucggcaccgcaugguguagcugccgagaaggauuuaugaaagccuccgacggcaaaaccugucuggcccuagauggccaccaacuccuugcgggcggcgaaguagaccuuaaaaaccaagugaccccgcuagacauacucucaaaaacgcgcgucucagaagacaacaucacagaaagccaacacaugcucguagcagaaaucaugguaagcgaccaagacgacugcgcacccguaggaugcagcauguaugcacggugcauaagcgaaggagaagacgcgaccugccaaugccuaaaaggauucgccggagacgguaagcucugcucagauauugacgaaugcgaaaugggaguacccguguguccacccgccagcucaaagugcaucaacacugaaggaggcuacgucugcagaugcagcgagggcuaucaaggcgacggcauccauugccuagauauagacgagugccagcuaggcgagcacucgugcggcgagaacgcgucgugcacaaacacggaagguggcuauacaugcaugugcgccggaagacucagcgaaccgggucuaauuugccccgacagcaccccaccuccacaccuucgcgaagacgaccaccacuacuccguccgcaacucggacucagaaugcccccucagucaugauggcuacugcuugcaugacggcguuuguauguauaucgaagcccuagacaaguacgcaugcaacugcgucguagguuacaucggagagcgcugccaauaucgcgaccuaaaauggugggaacucagacacgcaggucacggucagcaacaaaagguuaucgucguagccguuugugucgugguccuagucaugcuccuucuccuaucgcucuggggcgcccacuacuacagaacccaaaaacuccuauccaaaaacccgaaaaaucccuacgaagaaucgaguagggacguacguucgcgacgacccgcagacacggaagacggcaugaguucgugcccccaaccaugguucguaguuauuaaggaacaucaagauuugaaaaacggcggacagccagucgccggagaggacggccaagcagcagauggauccaugcaacccacaucauggagacaagaaccccaacuaugcggaaugggaacggaacaaggcugcuggauuccagucaguuccgacaaaggcucaugcccacaaguaauggaacgaucguuccacaugccauccuacggaacccaaacacucgaaggcgguguagaaaagccacacagccuccucucggcaaacccccuauggcagcagcgcgcacuagacccuccccaucaaauggagcugacccaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7095 - RNA, 786 nt, Artificial Sequence
  mRNA product Design5 comprising derived and/or modified sequence from Homo sapiens__NP_001423.1__HsEREG (opt9)
gggagagucccgcagucggcguccagcggcucugcuuguucgugugugugucguugcaggccuuauucaagcuuaccaugaccgccggcagacgcauggaaaugcuaugcgccggccgaguccccgcacuccuacucugccucggcuuccaccuccuacaagccguccuauccaccacagucaucccaucaugcaucccaggcgaaagcucugacaacugcaccgcccuaguccaaaccgaagacaacccccgcgucgcccaagucuccaucacaaaaugcucauccgacaugaacggcuacugccuacacggccaaugcaucuaccucgucgacaugucccaaaacuacugcagaugcgaagucggcuacaccggaguccgcugcgaacacuucuuccucacaguacaccaaccucucuccaaagaauacgucgcccucaccgucauacucauuauccucuuccucaucaccguagucggcuccacauacuacuucugccgcugguaccgcaaccgcaaauccaaagaacccaaaaaagaauacgaacgcgucaccuccggcgaccccgaacucccccaaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7096 - RNA, 744 nt, Artificial Sequence
  mRNA product Design5 comprising derived and/or modified sequence from Homo sapiens__NP_000791.1__HsFGF1 (opt9)
gggagagucccgcagucggcguccagcggcucugcuuguucgugugugugucguugcaggccuuauucaagcuuaccauggccgaaggcgaaaucacaaccuucaccgcccucaccgaaaaauucaaccucccccccggcaacuacaaaaaacccaaacuccuauacugcuccaacggcggacacuuccuccguauacuccccgacggcacagucgacggcacccgagaccgcucugaccaacacauccaacuccaacucucagccgaaucagucggcgaagucuacauaaaauccaccgaaacaggccaauaucucgcaauggacaccgacggccuucucuacggcucccaaacccccaacgaagaaugccucuuccucgaacgccuagaagaaaaccacuacaacacauacaucuccaaaaaacacgcagaaaaaaacugguucguaggccucaaaaaaaacggcuccugcaaacgcggcccccgcacccacuacggccaaaaagccauccucuuccucccccuacccgucucauccgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7097 - RNA, 1143 nt, Artificial Sequence
  mRNA product Design5 comprising derived and/or modified sequence from Homo sapiens__NP_001997.5__HsFGF2 (opt9)
gggagagucccgcagucggcguccagcggcucugcuuguucgugugugugucguugcaggccuuauucaagcuuaccaugguagggguaggaggaggggauguagaagaugugacgccaaggccaggagggugucaaauaagcggaagaggggcaagaggcuguaacgggauaccgggggcagcggcgugggaggcagcgcugccgagaagacgaccacgaaggcauccgagugugaacccgcggucaagagcggcagggagcccgagaacgagagggagaagaacagaggaaaggccaaguggaaguagauuaggggauaggggaagagggagggcgcuaccgggagggagauugggagggcgagggagagggagagcgccagagaggguaggagggcgggggcgggggagggggacagcggcgccgagagcggcaccagcagcgagagggagcaggccagggccggcggggacgauggcggcgggaagcauaacaacacugccggcguuaccggaggacggagggaguggggcguucccgccagggcacuuuaaagauccaaagagguuguauugcaaaaacggaggguucuuucugaggauacauccagaugggagaguagauggaguaagggagaaaucggacccacacauaaaacugcaauugcaagcagaagagagagggguagugagcauaaaaggggugugugcaaacagauaccuagcgaugaaggaagauggaagacuguuagcgucgaaauguguaacggacgagugcuuuuucuuugaaaggcucgagagcaauaacuauaacacauacaggagcaggaaguauacaucaugguauguagcacucaagagaacgggacaauacaagcuagggagcaagacggggccggggcaaaaggcaauacuauuucuaccgaugucggcaaagagcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7098 - RNA, 861 nt, Artificial Sequence
  mRNA product Design5 comprising derived and/or modified sequence from Homo sapiens__NP_002000.1__HsFGF7 (opt9)
gggagagucccgcagucggcguccagcggcucugcuuguucgugugugugucguugcaggccuuauucaagcuuaccaugcacaaauggauccucaccuggauccuacccacccuccuguaccgcagcugcuuccacaucaucugccucgucggaaccauaucccucgccugcaacgacaugacccccgaacaaauggccacaaacguaaacugcagcucccccgaacgccacacccgcuccuacgacuacauggaaggcggagacauccgcguacgccgccuauucugcagaacccaaugguaccuacgcauagacaaaagaggcaaagucaaaggcacacaagaaaugaaaaacaacuacaacaucauggaaauccgcaccgucgcagucggaaucguagccaucaaaggagucgaaagcgaauucuaccuagccaugaacaaagaaggcaaacuauacgccaaaaaagaaugcaacgaagacugcaacuucaaagaacuaauccucgaaaaccacuacaacaccuacgccuccgccaaauggacccacaacggcggcgaaauguucguagcccucaaccaaaaaggaauacccguccgcggaaaaaaaaccaaaaaagaacaaaaaaccgcccacuuccuccccauggccaucaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7099 - RNA, 903 nt, Artificial Sequence
  mRNA product Design5 comprising derived and/or modified sequence from Homo sapiens__NP_001936.1__HsHBEGF (opt9)
gggagagucccgcagucggcguccagcggcucugcuuguucgugugugugucguugcaggccuuauucaagcuuaccaugaaacuccuccccuccgucguccucaaacucuuccuagccgcaguccucuccgcacucgucaccggcgaaucccucgaacgacuccgacgcggccuggccgcaggcaccuccaaccccgacccaccaaccgucucaacagaccaacuacuaccccucggcggaggccgcgacagaaaaguccgcgaccuucaagaagcagaccucgaccuccuccgagucacccucuccagcaaaccccaagcccucgccacacccaacaaagaagaacacggaaaacgcaagaaaaaaggcaaaggccucggcaaaaaacgcgaccccugccuacgcaaauacaaagacuucugcauccacggggaaugcaaauacgucaaagaacuacgcgcccccucaugcauaugccaccccggcuaccacggcgaacgcugccacggccucucccuccccguagaaaaccgacucuacaccuacgaccacaccaccauccucgccgucgucgccgucguccucuccuccguaugccuacucgucaucguaggccuccuaauguuccgcuaccaccgccgaggcggcuacgacgucgaaaacgaagaaaaagucaaacucggaaugaccaacucccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7100 - RNA, 2463 nt, Artificial Sequence
  mRNA product Design5 comprising derived and/or modified sequence from Homo sapiens__NP_000592.3__HsHGF (opt9)
gggagagucccgcagucggcguccagcggcucugcuuguucgugugugugucguugcaggccuuauucaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7101 - RNA, 2202 nt, Artificial Sequence
  mRNA product Design5 comprising derived and/or modified sequence from Homo sapiens__NP_005336.3 __HsHSPA1A (opt9)
gggagagucccgcagucggcguccagcggcucugcuuguucgugugugugucguugcaggccuuauucaagcuuaccauggcuaaagcggcggcaaucggaauagaccucggaaccaccuacucaugcgugggcguuuuucagcacggcaaaguagaaauaauagcaaacgaucaaggaaacaggacaacucccucguacguggcauuuacagacacagagagacugauuggggacgccgccaaaaaccaagucgcacugaacccccagaacacaguuuucgacgcgaaaaggcucauaggacgaaaauucggagacccagugguccaaagugacaugaagcacuggccauuccaagugauaaaugacggcgacaaacccaagguacaagucucguacaaaggcgaaaccaaggcauucuacccagaagagauaucguccaugguccucacaaagaugaaagaaauagccgaagccuaccucggguacccagucacaaacgcggucauaaccguacccgcguacuucaacgacagccaacgacaagcgacaaaagacgccggagucauagcaggccucaacguacugcgcauaaucaacgaaccgaccgcggcagccauagccuacgggcuagaccgcacaggaaaaggggagcgcaacgucuuaaucuucgaccuaggcggaggcacauucgacgucucaauacuaaccauagacgacggcaucuucgaaguaaaagccacagccggggacacgcaccuaggcggcgaagacuucgauaaccgccuaguaaaccacuucguagaagaguucaagagaaagcacaagaaagacauaagccaaaacaaacgggccgugcgcaggcuaaggaccgcaugcgaacgcgcaaaacgaacccucagcucaaguacccaagcaagccuggaaaucgacagucucuucgaaggaauagacuucuacaccuccaucacccgagcgcgauucgaagaacuaugcagcgaccuauuccgcucgacacuggaaccgguggaaaaagcacucagagacgcgaagcuagacaaagcccaaauccacgaccuaguauuggugggaggcaguacaagaaucccaaaaguacaaaagcuccuacaagauuucuucaacggaagggaccucaacaaauccaucaaccccgacgaagcaguggccuacggggcagcaguccaggcagccauacugaugggagacaaaagcgaaaacgugcaagaccuacuccuccuggacguagccccacuaagccuaggacucgaaacagccggaggaguaaugacagcacugauaaaaaggaacagcaccauccccacgaaacaaacccaaaucuucacaacguacucagacaaccaacccggagugcuaauacaaguauacgaaggcgagcgcgcaaugacuaaagacaacaaccuccugggcagguucgagcuaucaggaauaccaccggcaccacggggagucccgcaaauagaagugaccuucgacauagacgccaauggcauacuaaacguaaccgcaaccgacaaaucuaccgggaaagcaaacaagauaacgaucacgaacgauaaagggcgcuuaagcaaggaagaaaucgaacgcaugguccaagaagcagaaaaauacaaagccgaggacgaaguacaacgcgaaagagugagcgcgaaaaacgcacuagaaucauacgcguucaacaugaaaagcgcagucgaagacgaaggccucaaagggaaaauauccgaggccgauaaaaagaaaguacuagacaaaugccaagaagucauaagcuggcuagacgccaacaccuuagccgaaaaagacgaguucgaacacaaaaggaaagaacuggaacaaguaugcaaccccauuauauccggccuauaccaaggagcuggaggaccgggacccggcggauucggagcccaaggccccaaaggaggaagugggagcgggcccacgauagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7102 - RNA, 2202 nt, Artificial Sequence
  mRNA product Design5 comprising derived and/or modified sequence from Homo sapiens__NP_005337.2 __HsHSPA1B (opt9)
gggagagucccgcagucggcguccagcggcucugcuuguucgugugugugucguugcaggccuuauucaagcuuaccauggcgaaagccgcagccaucggaauagaccucggcaccaccuacucaugcgucggcguauuccaacacgggaaaguagagaucaucgcaaacgaccaaggaaacaggaccacaccaucauacguagccuucacagacaccgagcgccuaaucggagacgccgccaagaaccaaguugcgcucaacccacaaaacacagucuucgacgcaaaacgacugauaggccgaaaauucggcgacccagugguccaauccgacaugaagcacuggccauuccaaguaaucaaugacggagacaaacccaaaguacaggucagcuacaaaggagaaacaaaggccuucuacccagaagaaauaagcucaaugguccugaccaaaaugaaagaaauagcagaggcuuaccucggcuaccccguaacaaacgcggucaucaccguacccgcauacuucaacgacagccaacggcaagccacgaaagacgccggagucauagcaggccuaaacguacuccgcauuauaaacgaaccaaccgccgccgccaucgcauacggacucgaccgaacaggcaagggcgagagaaacguacugaucuucgaccucggaggaggaacauucgacgucaguauacucacgaucgacgacggaauauucgagguaaaggcaacggcuggagacacacaccuaggcggagaagacuucgacaacaggcuugucaaccacuucgucgaagaguucaaacgaaaacacaagaaagacauaagccaaaacaaaagggccguccguagacuaagaaccgccugcgaaagagcgaaaaggacacucagcuccucaacccaagcaagccuagaaauagacucacuauucgaaggcaucgacuucuacaccucgaucacccgugcacguuucgaagaacuaugcagcgaccucuuccgcucaacccuagaacccguagaaaaagcacuacgagacgcgaaacuagacaaagcgcaaauacacgaccugguccuaguaggaggcucaacaagaauaccuaaaguacaaaaacucuugcaagauuucuucaauggccgcgaccucaacaaaagcauaaacccagacgaagccgucgcauauggagccgcggugcaggcagcaauccuaaugggagacaaaagcgaaaacgugcaagaccugcugcuccuagacguagcaccacucucacuuggccucgaaaccgcaggaggcguaaugacugcacuuaucaaaaggaacucgaccauacccaccaaacagacacaaaucuucacuacauacucggacaaccagcccggaguccuuauccaaguauacgagggcgaacgcgcgaugacaaaagacaacaaccuacucggaagauucgaacucucaggaauaccaccagccccacgcggcgucccacaaaucgaaguaacauucgacaucgacgcgaacggaauauuaaacgucacagccacagacaaaucgaccggaaaagcaaacaaaauaacaaucacaaacgacaaaggccgacuuaguaaagaagaaaucgagcgaauggugcaagaagcggagaaauacaaagcagaagacgaaguacaaagagagcgaguauccgccaagaacgcccucgaaucauacgccuucaacaugaaaagcgcggucgaagacgaaggccuaaaggggaagauaagcgaagcagacaagaagaaaguacuagacaaaugccaagagguaaucagcuggcuagacgcaaacacccucgcugaaaaagacgaguucgaacacaaacgaaaagaacucgagcaagucugcaaccccauaaucucgggccucuaucagggagcgggaggacccggcccagggggcuucggagcgcaaggacccaaaggcggcagcggaagcggccccacaaucgaagaaguagacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7103 - RNA, 2202 nt, Artificial Sequence
  mRNA product Design5 comprising derived and/or modified sequence from Homo sapiens__NP_005518.3 __HsHSPA1L (opt9)
gggagagucccgcagucggcguccagcggcucugcuuguucgugugugugucguugcaggccuuauucaagcuuaccauggccacagccaaggggaucgcaaucggcaucgaccuaggaaccacauauuccugcguaggagucuuccagcacggcaaaguggaaauaaucgcaaacgaucaaggcaacagaacaaccccaagcuacguagcauucaccgacacagagagacugaucggcgacgccgcgaaaaaccaaguggcaaugaacccacagaacaccgucuucgacgccaaacggcucauaggcagaaaauucaacgaccccguaguacaagccgacaugaaacucuggcccuuucaagucauaaacgaaggcggaaagcccaaaguccuaguaagcuacaaaggcgaaaacaaggccuucuaccccgaagaaaucucgagcaugguccucaccaagcugaaggaaacagcagaagccuuccuaggccacccaguaacaaacgccguaauaacagugccagcauacuucaacgacagccaacgacaagcgaccaaggaugcggguguaauagcgggccucaacguccuacgaaucauaaacgaaccuacagcggccgccaucgccuacggacuggacaaaggaggccagggagaaagacacguacugauauucgaccuaggaggcggcaccuucgacgucucaauacugaccaucgacgauggcaucuucgaaguaaaagccacugcaggcgacacccaccucggcggcgaagacuucgacaaccggcucgucagccauuucgucgaagaauuuaaaaggaaacacaagaaagacaucucccagaacaaaagagcagucagacgacuucggaccgcgugcgaacgcgcaaaacgcacgcuaagcagcaguacacaagcaaaccuagaaaucgacucccuuuacgaaggaaucgacuucuacacaucaaucacccgcgcaagguucgaggagcucugcgccgaccucuuccguggcacccuagaacccgucgaaaaagcacuccgcgacgccaaaauggacaaggcaaaaauacacgacaucguacucgucgggggcucaaccagaauccccaagguccagcgccuacuacaagauuacuucaacggacgagaccucaacaaaagcauaaauccagacgaagcggucgcguacggcgcagcaguacaggccgcgauccuaaugggggacaaaagcgaaaaaguccaagaccuccuccugcuagacguagcaccgcuuucccuaggccuagaaacagccggagguguaaugaccgcccuaaucaaacgcaacagcacaauacccaccaaacaaacccaaaucuucaccacauacagcgacaaccagccgggcguccucauacagguuuacgaaggcgaacgcgcaaugacaaaagacaacaacuuacuaggacgauucgaccugaccggcaucccaccagcacccagaggcgucccccaaauagaaguaaccuuugacauagacgccaacggcauacuaaacguaacagccacagacaaaaguacgggcaaagucaacaaaaucaccauaaccaacgacaaaggcaggcucucaaaagaagaaaucgaacggaugguccuagacgcagaaaaauacaaagcagaagacgaaguacagcgagagaaaauagcggccaaaaacgcacucgaaagcuacgccuucaacaugaaaagcguuguauccgacgaaggauuaaaaggaaaaauaagcgaaagcgacaaaaacaaaauacucgacaaaugcaacgaacuccuguccuggcuggaaguaaaccaacucgccgaaaaagacgaguucgaccacaaacgaaaagaacucgaacaaaugugcaaccccauaaucaccaaacuguaccaaggcgguugcaccggaccagccugcggaaccggcuauguacccggacgcccagcgacaggcccaaccaucgaagaggucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7104 - RNA, 2196 nt, Artificial Sequence
  mRNA product Design5 comprising derived and/or modified sequence from Homo sapiens__NP_068814.2 __HsHSPA2 (opt9)
gggagagucccgcagucggcguccagcggcucugcuuguucgugugugugucguugcaggccuuauucaagcuuaccaugagcgcacgcggccccgcaaucgggaucgaucuaggcaccacauacucgugcguaggcguauuccaacacgggaaagucgaaaucaucgcaaacgaccaaggaaaccgcaccacccccagcuacguagccuucaccgacaccgaacgacucaucggagacgcagccaaaaaccagguagcaaugaacccaaccaacacaaucuucgacgcaaaaaggcugauaggccgaaaauuugaggacgccacgguccaaagugacaugaaacauuggcccuuccgcguaguauccgaaggaggcaaacccaaaguccaaguagaauacaagggcgagaccaagaccuucuucccggaagaaauauccagcaugguccugaccaaaaugaaagaaauagccgaagccuaccuugggggaaaaguccacagcgccgucauaaccguuccagccuacuucaacgacagccaacggcaagccacgaaagacgcaggcacaauaacaggacucaacguccuucgaauaauaaacgaaccaaccgcagccgcgaucgcauacgggcucgacaaaaaggggugugcagggggcgagaaaaacguguuaauauuugaccuaggcgggggcaccuucgacguaagcauccucaccauagaagacggcauauuugaagucaaaagcaccgccggagacacacaccugggaggagaagacuucgacaaucggaugguaagccaccucgcagaagaguucaagcgcaagcacaagaaagacauugggccaaacaaaagggccgugcgacgccucagaaccgcaugcgaacgcgcaaaacgcacccugagcucaaguacgcaagcaagcaucgaaauugacagucuguacgaaggaguagacuucuacacaucaauaacacgagcacgcuucgaagaacucaacgccgaccucuuccgcggaacacuagaacccgucgaaaaagcacuccgggacgcaaaacuggacaaaggccaaauccaagaaauaguacucgucgggggauccacccgaauaccaaagauacagaaacuacugcaagacuucuucaacgggaaagaacuaaacaagucgauaaaccccgacgaagcaguagcguacggcgccgccguacaagccgcgauccugauaggagauaaaagugaaaacgugcaagaccuacugcuccuggacgucacgccccuaucacucgggaucgaaaccgcuggcggaguaaugacaccccucauaaaaaggaacaccaccauaccaaccaaacaaacccaaacauucaccaccuacucggacaaccaaucaucugugcuaguacaaguauacgaaggcgaacgggcuaugacgaaagacaacaaucuacuagguaaguucgaccuaacaggcauacccccggcaccccgaggaguaccacaaauagaaguaaccuucgacaucgaugcaaacgggauacuaaacguaaccgcagccgacaaaucgaccggaaaagaaaacaaaaucacaaucacaaacgacaaaggacgccucagcaaagacgacauagaccgaaugguucaggaagcagagagguacaagagcgaagacgaagcgaaccgagaccgaguggcggccaaaaacgcacuggaaagcuacaccuacaauauaaaacaaacaguugaagacgaaaaacuccguggaaagaucagcgaacaagacaaaaacaaaauacuagacaaaugccaagaagucauaaacuggcuggaccgaaaccagauggccgaaaaagaugaauacgaacacaaacaaaaagagcuagagcgcguaugcaaccccauaaucucgaaacuguaccaaggcggaccaggaggaggaagcggaggaggaggaucgggcgcaagcggcggcccgacaaucgaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7105 - RNA, 2799 nt, Artificial Sequence
  mRNA product Design5 comprising derived and/or modified sequence from Homo sapiens__NP_002145.3 __HsHSPA4 (opt9)
gggagagucccgcagucggcguccagcggcucugcuuguucgugugugugucguugcaggccuuauucaagcuuaccaugagcguaguaggcaucgaccuaggguuucagagcugcuacgucgcagucgcaagagcggguggcauagaaacaauagcaaacgaauacagcgacagaugcacccccgcaugcaucucguuuggccccaaaaauagaagcauuggagcugcagccaaaagccaagucaucagcaacgcgaaaaacacgguacaaggcuucaagcgguuucacggaagggcauucagcgaccccuucguugaagcggagaaguccaaccuagcguacgacaucguccaacuacccaccggacugaccgguauaaaaguaacauacauggaagaagaaaggaacuuuacaacagaacaaguaaccgccaugcuccucagcaaacuaaaagaaacagcagaauccguccucaagaaacccgucgucgacugcgucgugucgguccccugcuucuacaccgaugcagaaaggcgcucagucauggacgcgacgcagauagcggggcucaacugccuacgccuaaugaacgagacgacagcagucgcccucgccuacggcaucuacaaacaagaccuucccgcacuagaagaaaaaccccgaaaugucgucuucgucgacaugggacacucagcauaccaaguaucuguaugcgcguucaaccgaggcaaacuuaaagugcuggccaccgccuucgacacaacacucggcggccggaaauucgacgaaguccuaguaaaucacuucugcgaagaguucggcaagaaauauaaacuagauauaaaauccaaaauacgcgcccuccugcgcuugagccaggaaugcgaaaaacucaaaaagcuaaugagcgcaaacgcgucagaccugccacugagcauagaaugcuucaugaacgacguagacguauccggaaccaugaaccggggaaaauucuuagaaaugugcaacgaccuccuagcacgcguugaacccccucuaagaucugugcuggaacaaacaaaacugaagaaagaagacaucuacgcaguagaaaucgucggaggggcaacucgaauaccggccgucaaagagaaaaucagcaaauucuucgggaaggaacucagcaccacccugaacgcagacgaagcgguaaccaggggcugcgcgcuccaaugcgccauacugucaccagccuucaaaguacgagaguucagcauaacagacguggucccauacccaauaagccuccgauggaacucaccagcagaagaaggcucgagcgacugcgaaguauucagcaaaaaccacgcagcaccauucuccaaaguccucacguuuuaccggaaagaaccguucacccucgaggcauacuacuccucaccccaagaccuccccuaccccgacccagccaucgcacaauucagcguccaaaaggucacuccccagagcgacggcaguagcagcaaagucaaagucaaaguccgcgucaacguacacgggaucuucagcguaucaucagccagccucguggaaguccacaagagcgaggaaaacgaggaaccaauggagaccgaccaaaacgccaaagaagaagagaaaaugcaagucgaccaggaagaaccccacguagaagaacagcagcagcaaacccccgcggaaaacaaagcagaauccgaagaaauggaaaccucgcaagccggcaguaaagacaagaaaauggaccaaccaccccaagcaaagaaagcaaaaguaaaaacguccacaguagaccugccaauagagaaccaacuacuuuggcaaauagaccgagaaaugcuaaacuuauacaucgagaacgaagggaaaaugaucaugcaagauaaacuagaaaaagaaagaaacgaugccaaaaacgcagucgaagaguacguuuacgagaugcgggacaaacuaagcggcgaguacgagaaguucgucuccgaggacgaccgcaacagcuucacacugaaacucgaagacaccgaaaacuggcuauacgaagacggcgaagaccaaccaaagcaaguauacgucgacaagcucgcggaacucaaaaaccucggccaaccaauaaaaauccgguuccaagaaagcgaggagagaccaaagcuauucgaagaacucggaaaacaaauccagcaauacaugaaaauuauaucaaguuucaaaaacaaagaagaucaauacgaucaucuggacgccgcagacaugacaaaaguagaaaaaucgaccaacgaagcaauggaauggaugaacaacaaauuaaaucugcaaaacaaacaaagccuaaccauggaccccguaguaaaaucaaaagagaucgaagccaaaaucaaagaacucaccuccacaugcagccccaucauaagcaaacccaagcccaaagucgaaccacccaaagaggaacagaaaaacgcagaacaaaacggccccgucgauggacagggcgauaaccccggaccgcaagccgccgaacaaggcacggacacagccgugcccucagacagcgacaagaaacuaccagaaauggacaucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7106 - RNA, 2796 nt, Artificial Sequence
  mRNA product Design5 comprising derived and/or modified sequence from Homo sapiens__NP_055093.2 __HsHSPA4L (opt9)
gggagagucccgcagucggcguccagcggcucugcuuguucgugugugugucguugcaggccuuauucaagcuuaccaugucagucgucggaauagaccucggauuccucaacugcuacauagccguagcacgcuccggagguauagagacaaucgccaaugaguacuccgacagguguacccccgcgugcaucagccugggcucccgcacucgcgccaucggcaacgcggcgaagucccaaaucgucaccaacgucagaaacacaauccacggauucaagaaacuccacggacgauccuucgacgaccccauaguccaaaccgagcgcauacgccugcccuacgaacuacagaaaaugccaaauggcagcgccggcguaaaaguccgcuaccucgaggaggaacgccccuucgccaucgaacaagucacaggcaugcuauuagcaaagcucaaagagaccuccgaaaaugcacucaagaaacccguggcagacugcguaaucagcauuccguccuucuucacagacgcagagcgacggucagucauggcagccgcacaagucgccggccugaacugucuccgacugaugaaugagacaacggccgucgcccucgcauacggcaucuacaaacaagacuuaccuccgcucgacgaaaaaccgagaaacgucgucuucaucgacaugggacacagcgcauaccaaguccucguaugugcauucaacaaaggaaaacuaaaaguucuugccaccacauucgauccauaccucggaggccgcaacuucgacgaagcacucguugacuacuucugugacgaguucaaaacaaaauacaaaauaaacgucaaagaaaacagccgcgcccuucuccgucuauaccaggagugcgaaaaacucaagaaacucaugagcgccaacgccagcgaucucccacuaaacaucgaauguuucaugaacgaccuggacgugaguuccaaaaugaaccgugcccaauucgagcaacucugcgccagcuuacuagcaagaguagaaccaccacucaaagcggucauggagcaagccaaucuccaacgggaagacaucagcuccauagagaucgucgggggagcaacccgaauacccgcuguaaaagaacaaauaacuaaauucuuccuaaaagacauaagcacaacccugaacgccgacgaagcagucgcccgaggcugcgcacuccagugcgccauacucucccccgcguucaaaguacgcgaguucaguaucacagaccucguaccauacucaaucacccuacgcuggaagacaucuuucgaagacggcuccggagaaugcgaagucuucugcaaaaaucaccccgcccccuuuuccaaagucaucacauuccacaaaaaggaaccguucgaacucgaagcguuuuacacgaaccuccacgagguaccauaccccgacgcgagaauaggaucauucaccauacaaaacguauucccacaauccgacggcgauucauccaaggucaaagucaaaguaagagucaacauacacggcaucuuuucagucgccagcgccagcgugauugagaaacaaaaccuugaaggcgaucacagcgacgcccccauggaaaccgaaacgagcuucaagaacgaaaacaaggacaacauggacaagaugcagguagaccaagaggaaggacaccaaaaaugccaugcagaacacacacccgaggaagaaaucgaccacaccggagccaaaacgaagucugccgucagcgauaagcaggaccgucucaaccaaacccucaagaaaggcaaaguaaaaagcauagaccuaccaauccaaagcucacucugccgccaacucgggcaagaccuccuaaacuccuacauagaaaacgaaggcaaaaugaucaugcaagauaaacuagaaaaagaacgcaacgacgccaaaaacgcagucgaagaauacgucuaugacuuccgagaccggcucggaaccgucuacgaaaaauucauaacccccgaggaccuaucaaaacuaagcgcuguccuagaagacaccgagaacuggcuauacgaagacggagaggaccaaccaaaacaaguauacguagacaagcuccaggagcucaagaaauacggccaacccauccagaugaaauacauggagcaugaagaaagacccaaagcacucaacgaccucggcaagaaaauccagcucguuaugaaaguaauagaagccuaccgaaacaaagacgagcgcuacgaccaccuagacccaaccgaaauggaaaaagucgaaaaaugcaucagcgaugccaugagcuggcucaacuccaagaugaacgcgcagaacaaacuaucccucacccaagaccccguaguaaaaguaucagaaauagucgcaaaaucgaaagaacuggacaacuucugcaacccaaucaucuacaagccgaaaccuaaagcagaggugccagaagacaaaccaaaagcaaauagcgaacacaacggaccaauggacgggcaauccggaacagaaaccaaaagcgauagcacaaaagacucaucccagcacacaaaaagcucaggggaaauggaggucgacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7107 - RNA, 2241 nt, Artificial Sequence
  mRNA product Design5 comprising derived and/or modified sequence from Homo sapiens__NP_005338.1__HsHSPA5 (opt9)
gggagagucccgcagucggcguccagcggcucugcuuguucgugugugugucguugcaggccuuauucaagcuuaccaugaaacuaagccuaguagcggcaaugcuccugcucuuaagcgccgcaagagcagaagaagaggacaagaaagaggacgucggcaccgucgucggcauagaccuaggcaccacguacagcugcgucgggguauucaaaaacggaagagucgaaaucaucgccaacgaccaaggcaacagaaucacacccagcuacguagccuucacccccgaaggagaacgccucauaggagacgcggccaaaaaccaacucaccagcaacccagagaacacaguauucgacgcaaaacggcuaaucggccggaccuggaacgaccccagcguccaacaagacauaaaauuccuccccuucaaggucgucgagaagaaaacaaaaccauacauucaagucgacauaggaggaggucaaacgaaaacauucgcacccgaggagauaagcgcaaugguacucaccaaaaugaaagaaaccgcagaagcauaccuuggaaagaaagucacgcaugccgucgucacagucccagccuacuucaacgacgcacaaagacaggcgaccaaagacgccggcacaaucgcaggacugaacguaaugcgcauaaucaacgagcccaccgccgcagccaucgcuuacgggcuagacaaacgagaaggagagaaaaacauccucguguucgaccuaggaggaggcacauucgacgucagccuccuaacaaucgacaacggaguguucgaagucguagccaccaacggcgacacgcaccucggaggagaggauuucgaccaaagaguaauggaacacuuuaucaaacuauacaaaaagaaaacaggcaaagacguacgaaaagacaacagagccgugcaaaaacuucgacgugagguagaaaaagccaaacgagcacugucgagccaacaccaagcaagaauagaaaucgagagcuucuacgaaggcgaagacuucagcgaaacccucacucgagcaaaauuugaagaacuaaacauggaccucuucagaagcacaaugaagccaguacagaaggugcucgaagacucagaccucaagaaaagcgauauagacgaaaucguccucgucgggggcagcacccggauaccgaaaauccaacaacucgucaaagaguucuucaacggaaaagaaccuagccguggaaucaacccagacgaagccgucgcguacggagccgcgguccaggcaggcguccuaucaggcgaucaagacacaggcgaccucguccuacuagacgugugcccacuaacacucggaaucgaaaccgugggcggagucaugaccaaacuaauaccccgcaacacagucguucccacgaagaaaagccaaauauucagcacggccucagacaaccagcccaccguaacaaucaaagucuacgaaggggaacgcccacucaccaaagacaaccaccuccugggcacguucgaucugacaggcauaccacccgcgccccgcggagucccgcaaaucgaaguaacauucgaaauagacgugaacgggauacugcgcgucacagccgaagacaaaggaaccggaaacaaaaacaaaaucacaauaacaaacgaccaaaaccgccuaacaccagaagaaauagaaagaaugguaaacgacgccgaaaaauucgcagaagaggacaagaaacuaaaagaacgcauagacacccgaaacgaacucgaaucauaugcauacucccucaaaaaccagaucggcgacaaagaaaaacuagggggcaaacugagcuccgaggacaaggaaacaauggaaaaagcaguagaggagaaaaucgaauggcuggaaagccaucaagacgcagacauagaggacuucaaagccaagaagaaagaacuugaagagaucguacaaccaauaaucucaaaacucuacggcucggcaggaccaccaccgacaggagaagaagacacggccgaaaaagacgaacuguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7108 - RNA, 2208 nt, Artificial Sequence
  mRNA product Design5 comprising derived and/or modified sequence from Homo sapiens__NP_002146.2__HsHSPA6 (opt9)
gggagagucccgcagucggcguccagcggcucugcuuguucgugugugugucguugcaggccuuauucaagcuuaccaugcaagccccaagagaacuagccguggggaucgaccucgggacaacauacuccugcguaggcguguuccaacaaggaagagucgaaauauuagcaaacgaccaaggcaacaggaccacaccaucguacguagcguucacagacacagaacgccuagugggagacgcagcaaagucgcaagcagcacuaaauccacacaacacggucuucgacgcaaagaggcuaauaggaaggaaguucgccgacacaaccguucaaagcgauaugaagcacuggccauucagagucgucucggaaggagggaaaccaaaagugcgggucugcuacagaggcgaagacaaaacauucuacccagaagagaucuccagcaugguacugagcaaaaugaaggaaacagccgaagccuaccucggccaaccagucaagcacgcggucauaaccguacccgccuacuucaaugacagccagcgccaagccacaaaagacgccggggcaauagccggacuaaacguacuacgaaucaucaacgaacccacggcagcagcgauugcauacggccuagaccgaaggggcgccggagaacgcaauguccugauauucgaccugggagggggcacauuugacgucuccguacuaucaauagacgcaggaguauucgaagugaaagcgacggcaggagacacgcaccuaggcggcgaagacuucgacaaccgucuagugaaccacuucauggaagaguucaggcgaaaacacggaaaagaucucagcggaaacaaacgcgcacuccgcaggcuaagaaccgcaugcgaacgcgcaaaaaggacccuaagcuccucgacacaggccacccucgaaauagacucccuauucgaaggagucgacuucuacacaagcaucacccgcgcgcgauucgaagaacuaugcagcgaccuuuuccgcucaacccuagaaccagucgaaaaagcucuccgcgacgcaaaauuagacaaagcacaaauccacgaugucguccuaguaggcggcucaacgcgcauaccaaaaguacaaaagcuccugcaagacuucuucaacgggaaagaacuaaacaaauccauaaaccccgacgaagcggucgccuacggcgcggcgguacaagcagcgguccugaugggcgacaagugcgaaaaagugcaagaccuacuacuccucgacgucgccccauuaagccucggacuggagacggcaggaggaguaaugacaacacuaauccagcgaaacgcgaccauacccacaaagcaaacccaaaccuuuaccacguacucagacaaccaaccgggagucuucauccaaguauaugagggcgaacgcgcaaugacaaaagacaacaaccucuugggccgcuucgaacucuccggcaucccacccgcgccccgaggcguaccgcaaauagaagugaccuucgacauagacgccaacgggauacuaagcguaaccgcgacagaccggucaaccggcaaagcgaacaaaaucacaaucaccaacgacaaaggacggcuaagcaaagaagaaguagaacgcaugguccacgaagccgaacaauacaaagccgaagacgaagcccaacgugaccgcgucgcagcgaaaaacucacucgaagcccacguguuccacguuaaaggaucccuccaagaagaaagccugcgcgacaagauacccgaagaagaccggagaaaaaugcaggacaaaugccgugaaguacucgccuggcucgaacacaaccaacuagccgaaaaagaagaauacgagcaucaaaaacgagaacuggaacaaauuugcagacccauauuuucgagacuguacgggggcccaggcgucccaggaggcucaagcugcggaacccaagccagacaaggagaccccagcacaggaccaaucauagaggaaguagacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7109 - RNA, 1380 nt, Artificial Sequence
  mRNA product Design5 comprising derived and/or modified sequence from Homo sapiens__P48741__HsHSPA7 (opt9)
gggagagucccgcagucggcguccagcggcucugcuuguucgugugugugucguugcaggccuuauucaagcuuaccaugcaagcaccccgcgaacucgcaguaggcaucgaccuaggcaccaccuacuccugcguaggcgucuuccaacaaggccgcguagaaauacucgccaacgaccaaggcaaccgcaccacccccuccuacgucgcauucaccgacaccgaacgccucguaggcgacgccgcuaaaucccaagccgcccuaaacccccauaacaccgucuucgacgccaaacgacucaucggccgaaaauucgcagacaccaccguacaauccgacaugaaacacuggccuuuccaagucguaucagaaggaggaaaaccaaaaguccgcgucugcuaccgcggagaagacaaaacuuucuaccccgaagaaauauccagcaugguccuaucaaaaaugaaagaaaccgccgaagcauaccucggccaacccgucaaacacgccgucaucaccgucccaaccuacuucuccaacucccaaagacaagccaccaaagaugcaggcgccauagccggccuaaaaguacuccccaucaucaacgaggccaccgccgcagccaucgccuauggacuagaucgccgcggcgccggcaaacgaaacguccugauauucgaccucggcggcggcaccuucgacgucucaguacucagcauagacgcaggcgucuucgaaguaaaagcaaccgcaggagauacacaucucggcggcgaagacuucgacaaucgacuugucaaccacuucauggaagaguucagacgcaaacacggcaaagaccuaucaggcaacaaacgcgcccuacgccgccuacgaaccgccugcgaaagagccaaacgaacacccagcuccucuacgcaagcaacacucgaaauagacucccucuucgaaggcgucgacuucuacaaauccaucacccgagcacgauucgaagaauuaugcuccgaccuguuccgcagcacccucgaacccguagaaaaagcccucagagacgcaaagcuggacaaagcccaaauccacgacuucguccucggaggcggccuccacucccacccccaaggcgcagaaguagcugcaggccuccuacaacgacagggagccgaacaagaacaccaacccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7110 - RNA, 2217 nt, Artificial Sequence
  mRNA product Design5 comprising derived and/or modified sequence from Homo sapiens__NP_006588.1 __HsHSPA8 (opt9)
gggagagucccgcagucggcguccagcggcucugcuuguucgugugugugucguugcaggccuuauucaagcuuaccaugucaaaaggaccggccgucggaaucgaccucggcaccaccuacagcugcgucggcguguuccaacacggaaaaguggaaaucaucgcaaacgaucaaggcaacaggaccacacccucguacguggcauuuaccgacaccgaacgccucauuggagacgcggccaaaaaccagguagcaaugaaccccaccaacaccgucuucgacgcaaaaaggcuaaucggcagacgauucgacgacgcagucguccagagcgacaugaaacacuggccauucaugguggucaaugacgcaggccgaccaaaaguccaagucgaauacaaaggcgaaaccaagagcuucuaccccgaagaaguauccagcauggugcugaccaaaaugaaagaaauagcagaggcauaccuaggaaagaccgucacgaacgcagucgugacaguacccgcauacuucaacgacucacaacgccaagccacaaaagacgccggaacaauagccggccuaaacguacuacgcauaauaaacgaaccaacagcagcagcaaucgccuacggacucgacaaaaaggucggggccgaacgcaacguccuaaucuucgaucuaggaggagggacauucgaugucagcauccugacaauagaagacgggauauucgaagucaaaagcacagccggcgacacccaccucggaggagaagauuucgacaaccgcauggucaaccacuuuauagccgaguucaagcgcaagcacaagaaggacaucagcgaaaacaaacgagccguacgccgacuacgcaccgccugcgaacgagcaaaacgcacccugucaagcagcacgcaagcgagcauagagaucgacagccucuacgaaggcauagacuucuacacauccauaacgcgagcacgguucgaagaacucaacgccgaccuguuccgcggcacccuagacccaguagaaaaagcccuacgagacgccaaacucgacaaaucacaaauccacgacauaguucuggucggcggcuccacaagaaucccuaaaauccaaaaacuacuccaagacuucuucaacggaaaagaacucaacaaaagcauaaaccccgacgaagcaguggcguacggagcagccguccaagccgcgauccuauccggcgacaagagcgaaaacguucaagaccuucuccucuuggacguaaccccgcuaucauuaggaauagaaaccgcgggaggaguaaugacaguacuaaucaaaaggaacacuacaauaccgaccaaacaaacacaaaccuucacgacauacucagacaaccaaccaggcgugcucauacaagucuaugaaggagaacgcgcaaugacaaaagacaacaaccuacucggcaaguucgaacucacagggaucccacccgcaccccgcggaguaccacaaauagaaguaaccuucgacaucgacgccaacggaauccucaacgucagcgccgucgacaaaucaacaggaaaagagaacaaaaucacgauaacaaacgacaaagggcgccugagcaaagaagauaucgaacgaaugguucaggaagccgagaaauacaaagcagaggacgaaaagcaacgcgacaaagucagcuccaaaaacucccuagaaucauacgcguucaacaugaaagcgacggucgaagacgaaaaacuacaaggcaaaauuaacgaugaggauaaacagaaaauacuagacaagugcaacgaaaucauaaacuggcucgacaagaaccaaacagcagaaaaagaagaguucgaacaucaacaaaaagaacucgaaaaagucugcaaucccauaauaaccaaacuguaccaaagcgcgggcgggaugcccggcgguaugccgggaggcuuccccggaggcggcgccccaccaagcggcggcgcauccucaggcccaaccaucgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7111 - RNA, 2316 nt, Artificial Sequence
  mRNA product Design5 comprising derived and/or modified sequence from Homo sapiens__NP_004125.3 __HsHSPA9 (opt9)
gggagagucccgcagucggcguccagcggcucugcuuguucgugugugugucguugcaggccuuauucaagcuuaccaugauaagcgccagccgcgcagccgcggcgaggcuaguaggcgcagcggcaaguagaggaccgacggcggcaagacaccaagacucauggaacggccugagccacgaggcguucagacuggugagccgacgcgacuacgcaagcgaggccaucaaaggagcagucgucggaaucgaccuagggacgacgaacucgugcguagcagugauggagggaaagcaggcgaagguccuggagaacgcggaaggagcgagaaccacgccaucagucguagcauucaccgcggacggagagaggcucgugggaaugccagcgaaaaggcaggcaguaacaaacccaaacaacaccuucuacgcgacaaaaaggcuaauagguagaagauacgacgauccagaagugcaaaaggacaucaaaaacguacccuucaagauaguacgagccagcaacggagacgcauggguagaggcacauggcaagcuauauagcccgagccagauaggggcguucguccucaugaagaugaaggaaacggcagagaacuaccugggacacacggcaaagaacgcggucauaacagugccagcguacuucaacgacagccaacggcaagcgacaaaggacgcagggcagauaaguggacucaacguccuacgcgucauaaacgaaccaacagcggcugcccucgcauacgggcucgacaagagcgaagacaaaguaauagcaguauacgaccugggcggaggcacauucgacauaucuauacuagaaauccagaaagggguauucgaaguaaaguccacaaacggcgacacguuccuuggaggggaagacuucgaccaagcgcuauugcgucacaucguaaaggaguucaagagagagacaggaguagaccucacaaaagacaacauggcgcugcaacgaguaagagaagcagcagaaaaagcgaagugugaacuaagcucuagcguacaaacagacauuaaccucccauaucucacaauggacaguucagggccgaaacaccuaaacaugaagcucacaagagcccaguucgagggaauagugaccgaccuaauccgcaggacaauagcgccgugccaaaaggcgaugcaggacgcagaagugagcaagagcgacaucggagaagucauauuaguagggggaaugaccaggaugccgaaagugcaacagacggugcaggaccuguucggcagagcaccgagcaaggcaguaaacccagacgaggcaguagcgaucggagcggccauacaagggggaguacuugcgggagacguaacggacguacuacuauuggacgugacgccauuaagccuaggaauagaaacacuagguggcguguucacuaaacucaucaaucgaaacaccacgauacccacaaagaaaucacaaguguucagcacagcggccgacggacagacccaggucgagauaaaaguaugccaaggagagcgagaaauggccggggacaacaaacuacucgggcaauucacacugauaggaauaccgccagcacccaggggaguaccccagauagagguaacauucgacaucgacgcgaacggaauaguccacgucagcgcaaaagacaaaggaacuggcagggagcaacaaauagugauccaaagcagcggcggacugagcaaggacgacauagagaacauggugaaaaacgcggaaaaauacgcggaggaggacaggagaaagaaagaaaggguagaagcaguaaauauggcggaagggauaauacacgauaccgagaccaagauggaagaguucaaggaucaacucccagcggacgaaugcaacaaauuaaaagaagaaauaagcaagaugagggaacuacuagcgcgcaaagauagcgaaacgggagaaaacauaagacaagccgcgagcagucuccagcaggccagccuaaaacuauucgaaauggcguacaagaaaauggcaagcgaaagagaagggagcgggagcagcggaacaggagagcaaaaagaagaucagaaagaagagaagcaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7112 - RNA, 2304 nt, Artificial Sequence
  mRNA product Design5 comprising derived and/or modified sequence from Homo sapiens__NP_079291.2__HsHSPA12A (opt9)
gggagagucccgcagucggcguccagcggcucugcuuguucgugugugugucguugcaggccuuauucaagcuuaccauggccgacaaagaggcaggcggaagcgacggaccccgagaaacagccccaacauccgccuacuccagcccagcaagaucacucggcgacaccggcaucacaccacucucaccgucucacaucgucaacgacaccgauucaaacguauccgagcaacaauccuuccuaguagucgucgccgucgacuucgggacaaccuccuccggcuacgcauauuccuucacaaaagaacccgaaugcauccacgucaugcgccgcugggaaggaggagaccccggcguauccaaccagaaaacgcccacuaccauccuacuaacccccgaacgaaaauuccacuccuucggcuacgcugcccgagacuucuaccacgaccucgacccaaacgaagccaaacaauggcucuaccuagaaaaguucaaaaugaaacuucauaccacaggcgaccucaccauggacaccgaucuaaccgccgcaaacggcaagaaagugaaagcucuugaaaucuucgccuacgcccuucaauacuucaaagaacaagcacuaaaagaacucuccgaccaagcaggcucagaguucgaaaacuccgacguucgcugggucaucacaguccccgcaauauggaaacaacccgccaagcaauucaugcgacaagcagcauaccaagccggucucgcaagcccagaaaauucagaacaauuaaucauagcacucgaacccgaagccgcguccauauacugccgcaaacuucgccuccaccaaaugauagaacucuccucaaaagccgcugucaacggguacuccgguagcgacacagucggcgccggcuucacacaagccaaggagcacauacgccgcaaccgccaaucgcgaacauuccucgucgagaacgucaucggagaaaucuggucagaacucgaagaaggcgacaaauacgugguagucgacagcggcggcggaaccguggaccuaaccguccaccagauacgccugccagaagggcaccuuaaagaauuguacaaagccacaggaggacccuacggaucauuaggagucgacuacgaguucgaaaagcugcucuacaaaaucuucggcgaagauuucauugaacaauucaaaauaaaacgccccgccgcaugggucgaucugaugauagccuucgaaucacguaaacgcgcagccgcucccgaccgaaccaauccacucaacaucacccuacccuucucauucaucgacuacuauaagaaauuccgcgggcacuccgucgaacaugcucuccgaaaaucaaacgucgauuucgucaaauggucaucccaaggcaugcuccgcaugucaccggacgccaugaacgcacuauucaaacccacuauagacucaauaaucgaacaccuacgcgaccucuuccaaaagcccgaaguaagcacagucaaauuccucuuccucgugggcggguucgccgaagccccacuccuccaacaggccguccaggccgcauucggagaccagugccguaucauaaucccacaagacguaggccuaaccauacucaaaggcgcaguccuauucggccuagaccccgccgucauuaagguccgccguucccccuuaacauacggagucggcguccuuaaccgcuaugucgaaggaaaacacccacccgaaaagcuccuagucaaggacggcacccgauggugcaccgacgucuucgacaaauucauauccgcagaccaaagcguugcacucggcgaacuugucaaacgaucauacacccccgcgaaacccucacaauuagucauagucauaaacaucuacuccucagaacacgacaacguuuccuucaucaccgaccccggcguaaagaaaugcggaacccucagacuggaccucaccggcacauccggcacugccguacccgcacgacgcgaaauacaaacccucaugcaguucggcgacaccgaaaucaaagcaacugccaucgacauagccacaucaaaauccguaaaaguaggaaucgacuuccuaaacuacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7113 - RNA, 2337 nt, Artificial Sequence
  mRNA product Design5 comprising derived and/or modified sequence from Homo sapiens__NP_443202.3 __HsHSPA12B (opt9)
gggagagucccgcagucggcguccagcggcucugcuuguucgugugugugucguugcaggccuuauucaagcuuaccaugcuagcaguccccgaaaugggccuacaaggccucuacaucggcuccagccccgaacguucacccguacccucaccaccaggcucaccaagaacccaagaaaguugcggcaucgccccacucacgcccucccaaucccccaagcccgaaguccgagcaccccaacaggcuucauucucugucgucguagcaauagacuucggaaccaccucuagcggcuacgcuuucucauucgccagcgaccccgaagccauccacaugaugcgcaaaugggaaggaggagaccccgguguagcacaccagaaaaccccaaccugccuacuccucacacccgaaggagccuuccacagcuucggcuacaccgcccgagacuacuaccacgaccucgaccccgaggaggcucgugacuggcucuacuucgaaaaauucaaaaugaaaauccacuccgccaccgaccucacccucaaaacucaacuagaagcgguuaacggaaaaacaaugcccgcccuagaaguuuucgcacacgcccugcgcuucuuccgagaacacgcacuccaagaacuucgcgaacaaagcccgagccuuccugaaaaagacaccguucgaugggucuugacaguccccgcaauauggaaacaaccggcgaaacaauucaugcgagaagcagccuaccuagccggacugguaucccgagaaaacgccgagcaacuacucaucgcacucgaacccgaagcugcauccgucuacugccgcaaacuacgccuccaccaacuccucgaccuguccggccgcgcaccaggaggcgguagauugggugagcgacgcaguauagacaguuccuuucgacaagcacgcgaacagcuacgccgaagccggcacucccgaacuuuccuuguagaaucaggcgucggcgaacucugggccgaaaugcaagcaggagacagauacguaguugcggacugcggcggcggcaccguugaccugacaguccaccaauuagaacaaccacacggcacucucaaagaacuuuacaaagcauccggcggacccuauggcgccguaggagucgacuuagcauuugaacaacuccugugcagaaucuucggggaagacuuuauagcaaccuucaaaagacaaagacccgcagccugggucgaccuuaccaucgcauucgaagcacggaaacgaacagccggcccacaccgagcaggagcccugaacaucagccuaccauucucauucaucgauuucuaccggaaacaacgcggccacaacgucgaaacagcccuccggcgaagcagcgucaacuucgucaaauggucaucccaaggaaugcuacgaauguccugcgaagcaaugaacgaacucuuccaaccaaccgucucgggcaucauccaacacaucgaagccuuacuagcccgcccagaaguacaaggagucaaacuccucuuccuagucggaggcuucgcagaguccgcaguccuacaacacgcgguucaggccgccuuaggagcacgcggccuccgagucgugguaccccacgacguaggccucacaauccuaaaaggcgccguucucuucgggcaagcucccggcgucguacgcguacgccgcagcccacuaaccuacggcguuggcguacucaaccgcuucgucccgggaagacacccacccgaaaaacuccuaguccgagacgguagacgcuggugcaccgacgucuuugaaagauucguggccgccgaacaaucagucgcccucggcgaagaaguccgacgcagcuacugccccgcacgccccggccaacgacgcguccucaucaaccuauacugcugcgcagcagaagacgcacgcuuuauaaccgaccccggcguccgaaaaugcggcgcacucucacucgaauuagaacccgcagacugcggucaagacaccgccggagccccgcccggaagacgagaaauccgcgccgcaaugcaauucggcgacaccgaaaucaaagucacagccgucgaugucuccacaaaccgaagcguaagggccucgauagacuuccuaaguaacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7114 - RNA, 1692 nt, Artificial Sequence
  mRNA product Design5 comprising derived and/or modified sequence from Homo sapiens__NP_008879.3__HsHSPA13 (opt9)
gggagagucccgcagucggcguccagcggcucugcuuguucgugugugugucguugcaggccuuauucaagcuuaccauggcaagagaaaugacaauccuuggcuccgccgugcuaacccuccuacuagccgguuaccucgcccaacaguaccuaccccuccccaccccaaaagucaucggaaucgaucucggcaccaccuacugcucagucggcgucuucuuccccggcaccggaaaaguaaaaguuauaccggacgaaaacggccacaucuccauccccucaauggucuccuucaccgacaacgacgucuacgucggcuacgaaagcguggaacucgccgacuccaacccccaaaauacaauauacgacgccaaacgcuucaucggcaaaaucuucaccgccgaagaacucgaagccgaaauaggccgcuacccuuucaaagugcucaacaaaaacggcauggucgaguucuccgucaccagcaacgaaacaauaacaguaucgccagaauacgucggcucccgccuccuccuuaaacuaaaagaaauggcagaagccuaccuaggcaugcccgucgccaacgcaguaaucucagucccagccgaguucgaccuuaaacaaaggaacuccaccaucgaagcagcuaaccucgccggccugaaaauccuccgagucaucaacgaacccaccgccgcggccauggcauacggacuucacaaagccgacgucuuccacguccucguaaucgaccugggcggcggcacccuagacgucagccuucucaacaaacagggaggcauguuccucacacgcgcgaugucaggaaacaacaaacuaggaggccaggacuucaaccaacgccuacuccaauaccuauacaaacaaauauaccaaaccuacggauucguuccaucccgaaaagaagaaauccacagacuccgacaagcaguagaaaugguaaaacucaaccuaacccuacaccaauccgcacaacuaagcguccuccuuacaguagaagaacaagaccgaaaagaaccacacuccuccgacaccgaacuccccaaggauaagcuauccagcgcugacgaccacagaguaaacuccgguuucggccguggccucagcgacaagaaaucuggugaaucacagguccuauucgaaaccgagauaucccgaaaacucuucgacacccucaacgaagaccucuuccagaaaauccucguccccauccaacaaguccucaaagaaggccaccucgagaaaacagaaaucgacgaagucguacucguaggaggcuccacacgcaucccccgcauccgacaaguaauccaagaguucuucggcaaagaccccaacaccucaguagacccugaccuggccgucguaaccggagucgccauccaggccggaauugauggcggauccuggccccuacaagugagcgcccucgaaaucccaaacaaacaccuccagaaaacaaacuuuaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7115 - RNA, 1806 nt, Artificial Sequence
  mRNA product Design5 comprising derived and/or modified sequence from Homo sapiens__NP_057383.2__HsHSPA14 (opt9)
gggagagucccgcagucggcguccagcggcucugcuuguucgugugugugucguugcaggccuuauucaagcuuaccauggccgcaauaggcguccaccuaggcugcaccagcgccugcgucgccgucuacaaagacggcagagcaggcguagucgccaacgacgccggagaccgcgucaccccagcagucgucgccuacagcgagaacgaagaaaucguggggcucgcagccaaacaaucccgcauccgaaauaucuccaacacagucaugaaaguaaaacaaauccuaggacgcaguucgucagauccccaggcccaaaaauacauagccgaaucaaaaugccuaguaauagagaaaaacggcaaacuccgauacgaaaucgacaccggugaagaaacaaaauucguaaacccagaagacgucgcacgccuaauauucagcaagaugaaagaaaccgcccacucugugcucggaagugacgccaacgacguagucaucaccguaccauucgacuucggcgaaaaacagaaaaacgcccuaggcgaagccgcaagagccgccgguuucaacguccugcgacucauacacgaaccaagcgccgcgcuccucgccuacggcaucggccaagacuccccaaccgggaaguccaacauccuaguauucaagcuaggaggcaccagucuaucccuauccgucauggaagucaacagcggcauauaccgcguacucucaaccaacacagacgacaacaucggcggagcccauuucaccgaaacacuagcccaauaccucgccuccgaguuccaacgcucuuucaaacacgacguccgcggcaacgcgcgcgccaugaugaaacuaaccaacagcgccgaaguagcuaaacacucacucucaacacucggcuccgcaaacugcuuucuugacagccuauacgaaggccaagacuucgacugcaacgucucaagagccagguucgaacuacuaugcucaccacucuucaacaaaugcaucgaagccauacguggacuacucgaccaaaacggauucacugccgacgacaucaauaaaguaguacucugcggaggaucuucacgaauaccuaaacuacaacaacucaucaaagaccucuucccagccgucgaacuucuuaacuccaucccacccgacgaagucauccccaucggcgccgccaucgaagccggcauccucaucggaaaagaaaaccuacuuguagaggacucccucaugaucgaaugcuccgccagagacauccuagucaaaggcguagacgagagcggcgccagccgauucaccguccuauuccccuccggaacaccacuaccagcccgacgccaacacacacuacaagccccaggaucaauauccuccgucugccucgaacucuacgaaagcgacggcaaaaacuccgcaaaagaagaaaccaaauucgcacaagucguccuccaagaccucgacaagaaagaaaacggccuccgcgacaucuuagcagugcucaccaugaaacgcgacggcagccugcacguaacaugcacagaccaggaaaccggcaaaugcgaagccaucuccauagaaaucgccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7116 - RNA, 2853 nt, Artificial Sequence
  mRNA product Design5 comprising derived and/or modified sequence from Homo sapiens__NP_006635.2 __HsHSPH1 (opt9)
gggagagucccgcagucggcguccagcggcucugcuuguucgugugugugucguugcaggccuuauucaagcuuaccaugagcguaguaggacucgacguagggagccaauccugcuacauagccgucgcccgcgccgguggcaucgaaaccaucgcaaacgaguucagugaccgaugcacccccuccguaauauccuucggaagcaaaaacagaaccauaggcguagcugcuaaaaaucagcaaaucacacacgcgaauaacacggucucaaacuucaaacgauuccacggcagagccuucaaugaccccuucauccaaaaagaaaaagaaaaccuaucauacgaccuaguaccccucaaaaacggaggcguaggaaucaaagucauguacaugggagaagaacaccuauucagcguagaacaaauaacugccaugcuacucaccaaacucaaggaaaccgcagaaaacucacugaaaaagccagucaccgacugcgugauaagcguccccucuuucuucaccgacgccgaacgccgaucgguccuagacgcagcccaaauagucggccuaaacugucuacgacuaaugaacgacaugacagcaguggcccugaacuacggcaucuauaagcaagaccugcccucgcucgacgaaaaaccacgcaucguaguauucgucgauaugggccacucagcauuccaagugucagccugcgcauucaacaagggcaaacucaaagugcuaggcaccgccuucgaccccuuucucggaggcaaaaacuucgacgaaaagcuaguggaacacuucugcgcagaauuuaaaaccaaauauaaacucgacgccaaauccaaaaucagagcccugcuacgacucuaccaagaaugcgaaaaacuaaagaaacugauguccuccaacucaaccgaccugccccugaacaucgaaugcuucaugaacgacaaagacgucuccgggaaaaugaacagaucacaauucgaagaacuuugcgccgaacuacuccagaaaaucgaaguaccacucuacucccuccuggaacaaacccaccuaaaagucgaagacguguccgccguagaaauugucggcggcgcaacacgcauaccggccguaaaagaacgaauagcgaaauucuucggcaaagacaucuccaccacccuuaacgcagacgaagccgucgcacgcggcugcgcccuccagugcgcaauacucucgccggccuucaaaguccgcgaguucuccgucacggaugccgucccauucccgaucucccugauuuggaaccacgacagcgaagacacugaaggaguccaugagguauucagccgaaaccacgcagcucccuucagcaaaguacucacauuccuacgccgcggaccauucgaacuggaagcguucuacagugacccccagggaguaccguacccggaagcaaaaaucggacgcuucguggugcaaaacguaucagcacaaaaggacggcgagaaaagccgcgucaaaguaaaaguaagaguaaauacgcacggaaucuucacaaucucaacagccucaauggucgaaaaaguacccaccgaggaaaacgaaaugagcuccgaagccgauauggaaugccucaaccaacgcccacccgaaaaccccgauacagacaagaacguccaacaagacaauuccgaagcgggcacacaaccccagguccaaacagacgcacagcaaacaagccaguccccacccucacccgagcucaccucggaagagaacaaaauacccgaugccgacaaagcuaacgagaaaaagguggaccaaccacccgaagccaagaaacccaaaaucaaagucguuaacguagaacuaccaauagaagccaaucuuguauggcagcucgggaaagaccuccugaauauguacaucgaaacagaaggcaaaaugaucaugcaggacaaacucgaaaaagaacgaaacgaugccaaaaacgccgucgaagaauacguauacgaguuccgagacaaacuaugcggccccuacgaaaaguucaucugcgaacaagaccaucaaaacuuccuccgacuccucaccgaaacagaagacuggcuauacgaagaaggcgaagaccaagccaagcaggcguacguagacaaacuagaggaacuaaugaaaaucgggaccccuguaaaaguacgauuccaagaagccgaagaacgaccaaaaauguuugaagaacugggacagcgccuccagcacuacgccaagaucgccgcagacuuccgcaauaaagacgaaaaauacaaccauauagacgaaagcgaaaugaaaaaggucgaaaagagcgucaacgaggucauggaauggaugaacaacgucaugaacgcucaagccaagaaaagucuagaccaagaccccguagugagggcgcaagaaaucaaaaccaaaauaaaagagcugaacaacacaugugaaccagucgucacgcaaccgaaaccaaaaaucgaaagcccgaaacucgagcgcacacccaacggacccaacaucgacaagaaagaagaagaccuagaagacaaaaacaacuucggugccgagcccccgcaccaaaacggugaaugcuaucccaacgagaaaaacagcgugaacauggaccuugacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7117 - RNA, 3276 nt, Artificial Sequence
  mRNA product Design5 comprising derived and/or modified sequence from Homo sapiens__NP_006380.1 __HsHYOU1 (opt9)
gggagagucccgcagucggcguccagcggcucugcuuguucgugugugugucguugcaggccuuauucaagcuuaccauggcagacaaagugagacgacaacguccgcgucggcggguuugcugggcacucguggcaguccuccuagcagacuugcucgcccuaagcgauacccuagcagugaugucuguagacuuaggaucggaaucgaugaaaguagccaucgucaaaccgggagugccaauggaaaucguacuaaacaaagaaucacgcaggaaaacccccgugaucgucacgcugaaagagaaugagcgauucuucggcgauuccgcagcauccauggcgaucaaaaacccgaaggcaacacugagauacuuucagcaccuccucggaaaacaggcagacaacccacacguagcccucuaccaagcacgcuuccccgagcacgaacuaacauucgacccccaacgccaaaccgugcacuuccaaaucagcagucagcuccaauuuagcccagaagagguacucggaaugguacucaacuacuccaggagccucgcugaagauuuugccgaacagcccauaaaagacgcagucauaacaguacccgucuucuucaaccaagccgaaagacgagcgguacuccaagcagcaagaauggccggccucaagguccuucaacugaucaacgacaacacagcgacagcacucuccuacggaguauucagaagaaaagacauaaacaccacagcacagaacaucauguucuacgacaugggaagcggaaguacuguuugcacaauaguaaccuaccaaaugguaaagaccaaagaggcaggaaugcaaccacaacuucaaauacgaggggucggcuuugacaggacucuaggaggacuggagauggaacuccggcuucgagaacgccuagcaggacucuucaacgaacaacgaaagggccagagagccaaagacguacgagaaaauccacgagcaauggccaaacuccuaagagaagcgaaccgacucaaaacgguccuaagcgcaaacgcggaccacauggcccaaaucgaaggacuaauggacgacguugacuucaaagccaaaguaacacgaguagaguuugaagaacucugcgccgaccucuucgaacgagugccaggaccgguacaacaagcacuccagagcgcagaaaugucccuagacgaaaucgagcaagugauccuaguaggaggcgcaacccggguaccacgcguacaagaaguauuacugaaagcggugggaaaagaagaguuagggaaaaacauaaacgccgacgaagccgcagcaaugggagcaguauaccaagccgcggcccucagcaaagccuucaaaguaaaacccuucguagugcgggacgcagucguauacccaauacugguggaguuuaccagagaagucgaagaggaacccggcauccacagccuaaaacacaacaaaagaguccuguucuccaggaugggacccuacccacaacgcaaggugauaacauucaaccgauacagucacgacuuuaacuuccacauaaacuauggggaccugggcuuccuaggacccgaggaccuccgcgucuucggaucccaaaaccuaacaaccguaaaacucaaaggaguaggagacucuuucaaaaaguaccccgacuacgaaucaaaggggauaaaagcccacuuuaaccucgacgaaagugggguccucagccuggaccgcguagagucggucuucgaaacacucgucgaagacagugccgaagaagaaucaacccuaacgaaacuaggcaacacaauaucaagccucuucggaggaggcacaacaccugacgccaaagaaaacggaacagacaccguacaagaagaagaggaaagccccgcggagggaucaaaagacgaaccaggcgaacagguggaacucaaagaagaagcggaagccccagucgaggauggaagccaacccccaccacccgaaccgaaaggcgacgcaacaccggaaggcgaaaaggccaccgagaaagaaaacggggacaagucagaagcccaaaagccaagugaaaaagccgaagcaggcccagaaggaguagccccggccccagaaggagagaaaaagcagaaacccgccaggaaacgccgaaugguggaggagauaggcgucgaacucguaguacuggaucuaccagaccuccccgaagauaagcuagcacaaagcgugcaaaaacuccaggaccucacccugcgcgacuuagaaaaacaagagagagagaaagcagcaaacagccuggaggccuucaucuucgaaacacaagacaagcuguaccagcccgaauaccaagaagugagcacggaagaacaaagagaagagaucuccggcaagcuauccgcagccagcacguggcucgaagacgaaggaguaggggccacaacaguuaugcucaaagaaaaauuagcagaacuaagaaagcuaugccaaggacuauuuuucagaguggaagagagaaagaaauggccggaaaggcucagugcccucgacaaccuacucaaccauuccagcauguuccugaagggcgcaaggcuaauaccagaaauggaccaaauauucacagaaguagaaaugaccacucucgagaaaguaauaaacgagacaugggcguggaaaaacgcaacccucgcagaacaagcgaagcugccagccacggagaagccgguucuacucagcaaggauauagaagcaaagaugauggcacuagacagagaaguccaguaccuguuaaacaaagcaaaauucacaaaaccacgcccaaggccgaaagacaaaaacggaacacgagcagaaccaccacugaacgcgucagcuucagaccaaggagaaaaaguaauacccccagcagggcaaaccgaggacgcagaaccaaucagugaaccagagaaaguugagacgggaagcgaaccaggagacacggaacccuuagaauuaggaggcccaggcgcagaaccagaacaaaaagagcaaagcacuggccaaaagcguccccucaaaaacgacgagcuaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7118 - RNA, 2475 nt, Artificial Sequence
  mRNA product Design5 comprising derived and/or modified sequence from Homo sapiens__NP_005339.3 __HsHSP90AA1 (opt9)
gggagagucccgcagucggcguccagcggcucugcuuguucgugugugugucguugcaggccuuauucaagcuuaccaugcccgaagagacgcaaacgcaagaucaaccgauggaggaggaagaaguggaaaccuucgcguuccaggcagaaaucgcgcaacugaugagccucauaaucaacacguuuuacagcaacaaagaaauauuccugcgcgagcuaauaagcaacagcagcgacgcacucgacaagauacguuacgaaucccuaacggacccgagcaaacuagacagcgggaaggaacuacacaucaaccucauccccaacaagcaggaccgaacccugaccauagucgacaccggaauagggaugacgaaagcagaccucaucaacaaccucggaacgaucgccaaaagcggcacgaaggcuuucauggaagcacuacaagcgggcgccgacauaaguaugauaggccaauucggaguaggauucuacagugccuaccuaguggcagagaaagucaccguaauaacaaaacacaacgacgacgaacaauacgccugggaaagcagcgccgggggcuccuuuacaguaagaacagacaccggagaaccaaugggccgcggaacaaaaguaauacuccaccuaaaagaggaccaaacagaauaccucgaggaaagacgaauaaaggagaucgucaaaaagcacagccaauucauaggauacccaauaacgcuauucguggaaaaagaacgagacaaagaagugucagacgacgaagcggaggaaaaagaggauaaggaagaagagaaagagaaagaagaaaaagaaagcgaagacaagccagaaaucgaggacguagggucggacgaagaggaggaaaagaaagacggcgauaagaaaaagaaaaagaaaaucaaagaaaaguacaucgaccaagaggagcuaaacaaaacaaaaccgaucuggacacgaaacccagacgacaucacgaacgaggaauacggcgaguucuacaaaucacucacaaacgacugggaagaccaucuagcaguaaagcacuucagcgucgaaggccaacuggaguucagagcucuccuguucguacccaggcgcgcccccuucgaccucuucgaaaacagaaagaagaaaaacaacauaaaauuauacguaagacgaguauucauaauggacaacugcgaagaacugaucccggaauaccucaauuucauccgcggagucguagacagcgaggaccuaccacuaaacauaagcagagagaugcuacagcagaguaaaauccuaaaaguaauacggaaaaaccuugucaaaaagugccuggagcuauucaccgaacuugcagaggacaaagaaaacuacaagaaguucuacgagcaguucagcaagaauauaaaacuaggcauacacgaagacucacagaaccgcaagaaacuaagcgaacuccugagauacuacaccagcgccagcggggacgagauggucagccuaaaagacuacugcacaagaaugaaagaaaaccaaaaacacaucuacuauaucacgggagaaacaaaagaccaggucgcgaacucagccuucgucgagcgacuccgcaaacacgggcucgaaguaaucuauaugauagagcccauugacgaguacugcguacagcaacuaaaagaguucgaaggaaaaacccucguaagcgucacgaaagaaggccuagaacugcccgaagacgaagaggagaaaaagaaacaagaagaaaagaaaacaaaauucgaaaaccugugcaaaaucaugaaagacauccuggagaagaaaguggagaaaguagucguaagcaaccgccuaguaacgagcccaugcugcauagucacaagcacauacggauggacggcgaacauggagcgaauaaugaaagcccaagcccugcgagacaacagcacaaugggauacauggcggccaaaaagcaccuagaaaucaaccccgaccacuccaucaucgaaacacucagacaaaaagccgaagccgacaaaaacgacaaaagcguaaaggaccuggugauacuccuuuacgaaaccgcccugcucucaagcggcuucucccuggaggacccacagacccacgcgaacagaaucuacagaaugauaaagcugggccuaggaauagacgaagacgacccaacagccgacgacacauccgcagccgucaccgaagaaaugccaccccuagaaggggacgacgacacaagcagaauggaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7119 - RNA, 615 nt, Artificial Sequence
  mRNA product Design5 comprising derived and/or modified sequence from Homo sapiens__NG_005218__HsHSP90AA3P (opt9)
gggagagucccgcagucggcguccagcggcucugcuuguucgugugugugucguugcaggccuuauucaagcuuaccauggacucaucaaaacuagacuccggcaaaggccuacacauaaaccucguccccaacaaacaaaaccaaacccucaccaucguagacacacgcaucggcaugaccaaaaccgaccucaucaacaaccucggaaccgucaccaaauccggcacaaaagccuucauggaagcccuccaagcagacgcagacauauccaugaucggccacuucggaguaggcuucuacuccgccuaccucgucgccaaaaaagucaccgucaucucaaaacacaacaacgacgaacaauacaccugggaauccuccgcaggaggcagcuucaccguccgcaccgacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7120 - RNA, 2451 nt, Artificial Sequence
  mRNA product Design5 comprising derived and/or modified sequence from Homo sapiens__NP_031381.2__HsHSP90AB1 (opt9)
gggagagucccgcagucggcguccagcggcucugcuuguucgugugugugucguugcaggccuuauucaagcuuaccaugcccgaggaaguacaccacggagaagaggaagucgaaaccuucgccuuccaagcggaaaucgcccaacuaaugagcuugauaauaaacacguucuacuccaacaaagagauauuccugcgggagcuaauaucgaacgccagcgacgcccuagacaagaucagguacgagucccucaccgaccccagcaaacuagacucgggcaaggaacugaaaaucgacauaaucccgaacccgcaagagcgcacccucacccuaguggacacgggaauaggcaugaccaaagcagaccucauaaacaaccucggcaccauagccaagagcggaaccaaggccuucauggaagcacugcaagcaggagcagacauaaguaugaucgggcaauuuggcguaggguucuacucagcguaccucgucgccgaaaaaguaguagucauaacgaaacacaacgacgacgagcaauacgcgugggagucaagcgcaggagggagcuucaccguacgggcagaccauggcgaacccauaggcagaggcaccaaaguaauccuccaccuaaaggaagaccaaacagaguaccuagaagaacggagaguaaaagaagucgucaagaaacacucccaauucauaggcuaucccaucacacuauaccucgagaaagaacgagaaaaagaaauauccgacgacgaagccgaagaagaaaaaggggaaaaagaagaggaagacaaagacgacgaagaaaagcccaaaauagaagacguuggcucggacgaggaggacgacagcggcaaagacaagaaaaagaaaacgaagaaaauaaaagagaaauacaucgaucaagaagaacucaacaaaaccaaaccgaucuggacacggaaccccgacgauaucacgcaagaggaguacggcgaguucuacaaaucacuaacgaacgacugggaagaccaccucgcggucaagcacuucaguguggaaggccaacuagaguuccgagcgcuauuguucaucccaagacgcgcacccuucgaccucuucgaaaacaaaaagaagaaaaauaacauaaaacuguacguacgacggguguucaucauggacagcugcgacgaauugauaccggaauaccugaacuucauccgaggagucguggacucagaagaccucccacuaaacaucucccgagaaaugcuucaacagagcaaaauccuaaaagugaucaggaaaaacaucguaaagaaaugcuuagaacuauucagcgaacuagcagaggacaaagaaaacuacaagaaauucuacgaagccuucagcaaaaacuugaaacuaggcauacacgaagacagcacgaaccgaaggcgcuuguccgaacuacuacgcuaccacacgucccagagcggcgacgagaugaccagccugagugaauacgugagccgcaugaaagaaacgcagaaaagcauauacuacauaacaggcgaaagcaaagaacaaguagcgaacagugccuuugucgaaagaguacgaaaacgcggauucgaggucguauacaugacggaaccaauagaugaguacugcguccaacaacuaaaagaguucgacgggaaaagccuagucaguguuacgaaagagggccucgaacuacccgaagacgaggaggagaaaaagaaaauggaagaaagcaaagcaaaauucgaaaaccugugcaagcucaugaaagaaauauuggacaagaaagucgaaaaaguaacgaucucgaaucgacucguaucaucccccugcugcauagucacgagcacauacggauggacagcgaauauggagcggaucaugaaggcacaagcccuacgcgacaacagcaccaugggcuacaugauggcgaagaaacaccucgagauaaacccagaccacccgaucguggagacgcuaagacagaaagcagaagccgacaaaaacgacaaagccguaaaagaccuaguaguacugcuauucgaaacagcccugcucagcagcggauucucacucgaagacccgcaaacccacagcaaccgaaucuaccgcaugaucaagcucggacucggcaucgacgaagacgaaguagccgccgaagaaccgaacgcagccgucccugacgagauaccgccccucgaaggcgacgaggacgcaagccgaauggaggaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7121 - RNA, 2688 nt, Artificial Sequence
  mRNA product Design5 comprising derived and/or modified sequence from Homo sapiens__NP_003290.1__HsHSP90B1 (opt9)
gggagagucccgcagucggcguccagcggcucugcuuguucgugugugugucguugcaggccuuauucaagcuuaccaugcgagccuuauggguccucggacucugcugcgugcuacugaccuucggcagcguaagagcagacgacgaggucgacguagacggcacgguagaggaagaccucggcaaaucgcgagaaggcucacgcacagacgacgaaguaguccagcgagaagaagaagcgauacaacuugacgggcugaacgcgagccagauccgcgaacucagggagaaaagugaaaaauucgcauuucaggcagaaguuaacaggaugaugaagcuaaucauaaauucccuguacaaaaacaaagagaucuuccuacgggaacuaauaucaaacgccagcgacgcucuagacaaaaucagacuaauaagccuaacagacgaaaacgcacuaagcggaaacgaagaauugacagucaaaaucaagugcgacaaagagaaaaaccugcugcacgucaccgacacaggcgugggcaugacccgagaggaacucgucaaaaaccugggaacgauagcaaagucagggaccagcgaguuccucaacaaaaugacagaagcccaggaggacgggcagagcacgagcgaacugauagggcaauucggaguaggauucuacagcgcguuccugguagcggacaaagucauagucaccagcaaacacaacaacgauacccagcacaucugggagagcgacaguaacgaauuuagcguaaucgcagacccucgaggcaacacacuagggcgagggaccacaauaacacugguacuaaaggaagaagccagugacuaccucgagcuagauaccaucaagaaucucguaaagaaauacucacaauucaucaacuucccaaucuacgucuggagcagcaaaacagaaacgguugaagaaccuauggaggaagaggaagcggcaaaagaggaaaaggaagaaucagacgacgaggccgccguggaagaggaagaagaggaaaagaaaccaaaaacgaagaaaguggagaaaacaguaugggacugggaacugaugaacgacaucaagcccauauggcaaagaccaagcaaggaaguagaagaagacgaguacaaggcguucuacaaaaguuucuccaaggagucagacgaccccauggcauauauacacuucacggcagagggcgaagucacauucaagagcauacucuucgugcccaccucggcaccacgcggacuauucgaugaguacgggagcaagaaaagcgacuacauaaaacuauacgucaggaggguauucauaacggacgacuuccacgacaugaugcccaaguaccugaacuucgucaagggaguagucgauagcgaugaccuaccccugaacguaagcagggaaacccuacaacaacacaaacuucucaaaguaauccggaaaaagcucgugaggaagacccuagacaugauaaagaaaauagcggacgacaaauacaacgacacauucuggaaagaguucgggacaaacauaaaacuaggugugauagaggaccacagcaacaggacgagacuggccaaacuccuacgauuccaaucaagccaucaccccacagacaucacgagccuagaccaguacguagaaagaaugaaggaaaaacaggacaaaauuuacuucauggcaggguccagcagaaaagaggccgaaagcucccccuucgucgaaaggcugcucaagaaaggguaugaagucauauaccuaacagagccagucgaugaauacugcauacaggcacugccagaguuugacggcaagagauuccaaaacgucgcaaaagaaggagugaaauucgacgaaagugagaagaccaaagagagcagagaagccgucgagaaagaguucgaaccucuccucaacuggaugaaagacaaagcgcuaaaagacaagauagaaaaagcagucguaagccaacgacucacagaaagcccaugcgcgcuagucgccucgcaauacggauggucagggaacauggaaagaaucaugaaagcgcaagcguaccaaacugggaaagacauauccacgaacuacuacgccagccaaaagaaaacguucgaaaucaaccccaggcauccacugauaagggauaugcuacgcagaauaaaagaagacgaggacgacaaaacaguccucgaccucgcagucguccucuucgaaacggcaacccuuagaagcggcuaccugcugccagacaccaaagccuacggagacaggaucgagcgaaugcuacgacucucacuaaacauagacccggacgcaaaaguagaggaagaaccggaggaggagccagaagaaacagccgaagauacaacagaggacacggaacaagacgaagacgaagaaauggacguagguacagacgaggaagaagaaacagccaaagagagcacagcggagaaggacgagcuauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7122 - RNA, 2391 nt, Artificial Sequence
  mRNA product Design5 comprising derived and/or modified sequence from Homo sapiens__NP_057376.2__HsTRAP1 (opt9)
gggagagucccgcagucggcguccagcggcucugcuuguucgugugugugucguugcaggccuuauucaagcuuaccauggcccgagaauuaagagcccuauuacucuggggacgucgucuccguccccuccuccgcgcaccagcccuagcagccguacccggcggcaaacccauucucugcccaagaagaaccacugcccagcuagggccccgacgaaaccccgcguggucgcuccaagcuggacgacucuucucaacccaaaccgcagaagacaaagaagaaccccuccacagcaucauaucuucaacagaauccguccaagguagcacauccaaacacgaguuccaagccgaaaccaagaaacuguuagauaucgucgcccgcucccucuacagcgaaaaagaagucuucauccgcgaacugaucucaaacgccagcgacgcccuagagaaacuacgccauaagcuagucucagacggccaagcacuacccgaaauggaaauucaccuccaaaccaacgccgaaaaaggcaccauaacaauccaagacaccggaaucggcaugacccaagaggaacucguaagcaaccucggcacuaucgcgcgcucagggucaaaagcauuccuagacgcuuuacaaaaccaggccgaggcuucauccaaaauaaucggccaauucggcguaggcuucuacucagccuucauggucgcggaucgcgucgaagucuacucccgcagcgcagccccagggagccuaggguaccaguggcucagcgacggcuccggcguauucgaaaucgccgaagccuccggagucagaacaggaaccaaaaucauaauucaccugaaaucugacugcaaagaguucagcuccgaagcacgcguucgagacguagucacaaaauacuccaacuucgucuccuucccacucuaccucaacggaagacgcaugaacacccuccaggccaucuggaugauggaccccaaggacguccgugaauggcaacacgaagaguucuaccgauacguggcacaagcccacgauaaaccacguuacacccuacacuacaaaaccgacgccccacucaacaucagaagcaucuuuuacguccccgacaugaaaccgucaauguucgacgucucccgugaacuaggauccuccgucgcacucuacucacgcaaaguccuaauccaaacuaaagccacagacauccuucccaaauggcuccgguucauacgcggcgucguggacucagaagacaucccccuaaaccucucccgcgaacuacuccaagaauccgcgcuaauccgaaaacuuagagacguacuacaacaacggcuaaucaaauucuucaucgaccagaguaagaaagacgccgaaaaauacgcuaaauucuucgaagacuacggacuauucaugcgagaaggcaucgucaccgccaccgaacaagaagucaaagaagauaucgcaaaacuccuacgcuacgagucuuccgcccuacccucaggacaacuuaccucacuaagcgaauacgccagccgcaugcgcgcgggcacacggaauauauacuaccuaugcgcacccaaccgacaucucgccgaacacagcccauacuaugaagccaugaagaagaaagacacugaaguccuauucugcuucgaacaauuugaugagcucacccuacuacaccuccgggaauuugacaaaaagaaacuaauauccgucgagaccgacaucgucguagaccacuacaaagaggaaaaauucgaggaccgcuccccagcagccgagugccuaagcgaaaaagaaaccgaagaacuaauggccuggaugcgcaacguucuaggcucaagaguaaccaacguaaaaguaacccuacgacucgacacccaccccgccaugguaaccguacucgaaaugggagcagcccgccacuuccuacgaaugcaacaacucgccaaaacacaggaggaacgagcccagcuccuacagccaacacucgaaaucaacccccgacacgcacucaucaagaaacucaaccaacuccgggcauccgaaccaggacucgcccagcuccuaguagaccagaucuaugaaaacgccaugaucgcugcaggccuagucgacgacccaagagcaaugguuggacgacuaaacgaacugcucgucaaagcccucgagcgccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7123 - RNA, 738 nt, Artificial Sequence
  mRNA product Design5 comprising derived and/or modified sequence from Homo sapiens__NP_000609.1__HsIGF1 (opt9)
gggagagucccgcagucggcguccagcggcucugcuuguucgugugugugucguugcaggccuuauucaagcuuaccaugggcaaaaucuccucccuacccacccaacuauucaaaugcugcuucugcgacuuccuaaaagucaaaaugcacacaauguccucaucccacuuauucuaccucgcacucugccuccucacauucaccucauccgccaccgcaggccccgaaacccuaugcggcgccgaacucgucgacgcacuccaauucgucugcggcgaccgcggcuucuacuucaacaaacccacaggcuacggcuccuccucaagacgagcaccccaaaccggcaucguagacgaaugcuguuuccgaucaugcgaccuucgccgccucgaaauguacugcgcaccccucaaacccgccaaaucagcccgcuccguccgugcccaacgacacaccgacaugcccaaaacccaaaaagaaguccaccucaaaaacgccucccgcggcuccgcaggcaacaaaaacuaccgcauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7124 - RNA, 819 nt, Artificial Sequence
  mRNA product Design5 comprising derived and/or modified sequence from Homo sapiens__NP_000603.1__HsIGF2 (opt9)
gggagagucccgcagucggcguccagcggcucugcuuguucgugugugugucguugcaggccuuauucaagcuuaccaugggaauccccaugggcaaaucaaugcucguccuccucaccuuccucgccuucgccuccugcugcauagccgccuaccgacccuccgaaacacucugcggcggagaacucgucgacacccuacaauucgucugcggcgaccgaggcuucuacuucucccgacccgccucacgaguaucccgccgcucccgcggcaucgucgaagaaugcugcuuccgcucaugcgaccucgcccuccucgaaaccuacugcgccaccccagccaaauccgaacgagacgucuccaccccacccacaguacuucccgacaacuuuccccgauaccccguaggcaaauucuuccaauacgacaccuggaaacaaucaacccaacgacuccgccguggccuccccgcccuacuccgcgcacgccgcggacacguccuagcaaaagaacucgaagccuuccgcgaagccaaacgacaccgcccccucaucgcccuccccacccaagaccccgcccacggaggcgccccacccgaaauggccuccaaccguaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7125 - RNA, 915 nt, Artificial Sequence
  mRNA product Design5 comprising derived and/or modified sequence from Homo sapiens__NP_000591.1__HsIL6 (opt9)
gggagagucccgcagucggcguccagcggcucugcuuguucgugugugugucguugcaggccuuauucaagcuuaccaugaacuccuucuccaccuccgccuucggccccgucgccuucucccucggccuccuccucguccuccccgccgccuuccccgcccccgucccccccggcgaagacuccaaagacgucgcugccccccaccgccaaccccuaaccuccuccgaacgcaucgacaaacaaauccgcuacauccuagacggcaucucugcacuccgaaaagaaaccugcaacaaaucuaacaugugcgaauccuccaaagaagcccuagccgaaaacaaccucaacuuacccaaaauggccgaaaaagacggcugcuuccaauccggcuucaacgaagaaaccugccucgucaaaaucaucaccggccuccucgaauucgaagucuaccucgaauaccuacaaaaccgauucgaauccucagaagaacaagcccgagccguccaaauguccaccaaaguccucauccaauuccuccaaaaaaaagccaaaaaccucgacgccaucaccacaccugacccaaccaccaacgccucacuccucacaaaacuccaagcccaaaaccaauggcuccaagacaugacaacacaccucauccuccgcuccuucaaagaauuccuucaauccucccucagagcccuccgccaaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7126 - RNA, 1557 nt, Artificial Sequence
  mRNA product Design5 comprising derived and/or modified sequence from Homo sapiens__NP_002183.1__HsINHBA (opt9)
gggagagucccgcagucggcguccagcggcucugcuuguucgugugugugucguugcaggccuuauucaagcuuaccaugccccuacucuggcuacgcggcuuccuacuagcaagcugcuggaucauaguaagaagcucacccaccccaggaagcgaaggacacagcgccgcgccagacugcccaucaugcgcacucgccgcccuccccaaagacguacccaacagccagcccgaaaugguagaagcagugaaaaaacacauacuaaacaugcuccaccuaaaaaagcgacccgacguaacccaacccgucccaaaagcagcacuacuaaacgcaaucagaaaacuccacguagggaaagucggcgaaaacggauacguagaaaucgaagacgacauaggaaggcgcgccgaaaugaacgaacucauggaacaaacgucggaaauaaucacauucgcagaaucagguacggccagaaaaacccuacacuuugagaucagcaaagaagggagcgaccuaagcgucgucgaaagagcagaggucuggcuguuccucaaaguuccaaaagccaacagaacacgcacaaaaguaacaauacgccuauuccagcaacaaaaacacccacaaggcagccuagacaccggagaagaggccgaggaaguaggacuaaaaggagaacggagcgaacuacuacuaagcgaaaaagucguagacgcccgcaaaagcacauggcauguauuccccguaagcagcuccauacaacgacuccuagaccaaggcaaaucaucacucgacguaagaaucgcgugcgaacaaugccaagaaagcggagccagccuuguacuacugggcaagaaaaaaaaaaaagaagaggaaggcgaagggaaaaaaaaaggcggcggagaaggaggcgccggagcagacgaagaaaaagaacaaagccacagacccuuccuaaugcugcaagcacgacagagcgaagaccacccccaccgcagacgccgacgcggacucgaaugcgacggaaaaguaaacaucugcugcaagaaacaauucuucgucagcuucaaggacauaggauggaacgacuggauaauagcaccgagcggcuaccaugcaaacuacugcgaaggcgaaugcccaagccacaucgcaggcacaagcggaagcagccuaagcuuccacagcaccgucaucaaccacuacagaaugcgaggacacagcccauucgccaaccugaaaagcugcugcgucccgacgaaacuaagaccaaugagcaugcuauacuacgacgacggccaaaacauaauaaagaaagacauacaaaacaugauaguagaagagugcggcugcagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7127 - RNA, 1500 nt, Artificial Sequence
  mRNA product Design5 comprising derived and/or modified sequence from Homo sapiens__NP_002184.2__HsINHBB (opt9)
gggagagucccgcagucggcguccagcggcucugcuuguucgugugugugucguugcaggccuuauucaagcuuaccauggacggccuccccggccgagcacuaggcgccgcaugccuccuccuacucgcagccggauggcuuggccccgaagcauggggcuccccaacaccaccucccacccccgcagcaccacccccacccccaccacccggcucccccggcggcagccaggacacaugcaccucaugcggcggcuuccgacgccccgaagaacucggccgcgucgacggagacuuccucgaagccguaaaacgccacauccuuucccgccuccaaaugcgaggccgacccaacaucacucaugccguccccaaagccgccauggucaccgcccuacgcaaacuccacgccggcaaaguccgagaagacggccgcgucgaaaucccccaccucgacggccacgccagccccggcgccgacggccaagaacgaguuuccgaaaucaucuccuucgccgaaaccgacggccuugcauccagccgaguacgccucuacuucuucaucucaaacgaaggcaaccaaaaccucuucguaguacaagccucccuuuggcucuaucucaaacuccuacccuacguacuagaaaaaggcucucgccgcaaaguaagagucaaagucuacuuccaagaacaaggccacggcgaccgauggaacauggucgagaaacgcgucgaccuaaaacgcuccgguuggcacacauucccccucaccgaagcaauccaagcccucuucgaacgaggggaacgccgccucaaccuagauguccaaugcgacagcugccaagaacuagccgucguccccgucuucgucgaccccggcgaggaaucccaccgacccuucgucgucguccaagcacgacucggcgacucucgccacagaauacguaaacgaggacucgaaugcgacggccgcaccaaccucugcugcagacaacaauucuucaucgacuuccgccucauuggauggaacgacuggaucauagcacccacuggauacuacggcaacuacugcgaaggcuccugccccgcauaccucgcaggaguccccggaagcgcauccucuuuccacaccgcaguagugaaccaauaccgcaugcgcggccucaaccccggaaccgucaacagcugcugcauccccaccaaacuuuccaccaugagcaugcucuacuucgacgacgaauacaacaucguaaaacgagacguccccaacaugauaguagaagaaugcggaugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7128 - RNA, 3735 nt, Artificial Sequence
  mRNA product Design5 comprising derived and/or modified sequence from Homo sapiens__NP_000623.2__HsITGAM (opt9)
gggagagucccgcagucggcguccagcggcucugcuuguucgugugugugucguugcaggccuuauucaagcuuaccauggcacuaaggguacuccuccucaccgcccucacacucugccacggauucaaccucgacacugaaaacgcaaugacauuccaagaaaacgcgcggggcuucggacaaucagugguccagcugcaagguagccgcgucgucgugggcgccccgcaagagaucguagcagccaaccagcgcggcucucuauaucaaugcgacuacucaacuggcaguugcgaacccaucagacuacaagucccagucgaagcugucaacaugagccuuggacuaucgcuagccgcaacaaccucgccuccucaacuccucgccugcggcccaaccguccaccagaccugcuccgagaauaccuacgucaaaggccucugcuuuuuguucggcucuaaccugcgccaacaaccgcaaaaauucccggaagcccugcgaggcugcccccaggaagacucagacauagcuuuccuaauugacggguccggcuccaucauaccccacgacuuccgucgaaugaaagaguucguaucaacuguaauggaacaacucaagaaaucuaaaacgcuguucucacucaugcaauacagcgaagaguucaggauccacuucaccuucaaagaguuccaaaacaacccaaacccacgcucgcucgucaagccaauaacccaacuccucggcagaacccauacagcuacaggcauccgaaaagucgucagagaacucuucaacaucaccaacggcgcccggaaaaaugccuucaaaauccuuguagucaucaccgacggugaaaaauucggcgauccucuuggauacgaagacguaauuccugaagccgacagagaaggagugauucgauacgucaucggagugggcgacgcauuccgcagugaaaagucccgacaagaacugaacaccaucgccuccaaaccuccccgagaccacguuuuccaaguaaacaacuucgaagcacucaagaccauccaaaaccaacugcgcgagaaaauauucgcaaucgaaggcacgcaaaccggguccaguucauccuucgaacacgaaaugucccaggaaggauuuuccgcagcgaucacuuccaacggacccuuacuauccacagucggcucguacgacugggccggcggcguauuccuauacaccagcaaagaaaaauccaccuucaucaacaugacccgggucgacagcgacaugaacgaugccuaccucggguaugcagccgcaauuauacuaaggaaccgcguucaaucccucguacugggagcaccccgcuaccagcacauaggccuaguggcuauguuccgucaaaacacaggcaugugggaauccaaugccaacguuaagggcacgcaaauaggagccuacuucggcgccucucuaugcuccguagacguagacuccaacggauccacagaccuaguacugaucggcgcaccccacuacuacgaacaaaccagaggcggacaagucucaguguguccacucccccgcggucgagcacgauggcaaugugaugccguccuauacggcgaacagggacaaccguggggccgcuuuggagcugcccucaccguccucggcgauguaaacggugacaaacucacugauguagccauaggcgcccccggagaagaggauaacagaggagccgucuaccuauuccacggcaccucaggaagcgggaucagcccaucccacucccaacgcauagcgggcucaaagcuaucgccucgccugcaguacuuuggccaaagccucuccggcggccaagaccucaccauggacggucuaguagaccucacaguaggagcccaaggacauguacuccuccuucgcucgcagcccguacucagaguaaaggccaucauggaauuuaauccaagagaagucgcccgaaacguauucgaaugcaacgaucaggugguuaaagguaaagaagccggugagguacgcguaugucuccacguacaaaaaucgacccgggacagacuucgcgaaggacaaauccaaucaguagucaccuacgaccucgcucuagacuccggucguccccauucacgagccguguucaacgaaaccaaaaacucuacaagacgccaaacucagguacucggcuugacacaaacuugugagaccuuaaaacuucagcugccaaacuguaucgaggaccccgucuccccaaucguacugcggcuuaacuucucucucgucggcacaccccuuuccgcguucgguaaccugagacccguccucgcagaagacgcccaacgacucuucaccgcacucuuccccuuugagaaaaacugcggcaacgacaacaucugccaagaugacuuaagcauuacauucucauuuaugagccuagacugucucguaguaggcggaccccgggaauuuaacgucacuguaaccgugcgcaacgacggugaagacuccuacaggacgcaagucacauucuucuucccccucgacuuaagcuaccguaaagucagcacccuucagaaccagcguucucaacgauccuggaggcuugcgugcgaaucagcuagcucaaccgaggucuccggcgcgcucaaauccaccucaugcuccaucaaccaccccaucuuccccgaaaacagcgaaguuaccuucaacauaaccuucgacguagacuccaaggcaucacuaggaaacaaacuccuccucaaggccaacguaaccuccgagaauaacaugccacgcacgaauaaaacagaguuccaauuggaacuccccguaaaauacgcgguauacauggucgucacuucucacggaguaucuaccaaauaccuaaacuuuacagccuccgaaaacacaagccgaguaaugcagcaucaauaccaagugucaaaccugggacaaagaucgcuaccuaucucacucgucuuccugguaccggucaggcuuaaccaaacggucauaugggaccgcccccaaguaaccuuuucagaaaaccucuccagcacaugccacaccaaagaaaggcucccaucacauagcgacuuccuagcagagcuccgcaaggcgcccgucguuaacugcuccauagcagugugccaacgcauccagugcgacauaccauucuuuggcauccaggaggaguucaacgcaacccucaagggaaaccucucuuucgacugguacauaaaaacuucccacaaucaccuccuaaucgucuccaccgcagaaauccucuucaacgacagcguauucacccuacuaccaggccagggagcguucguccggagccaaaccgaaaccaaaguggaaccauuugaaguacccaaccccuuaccccuaaucgucggguccucagucggcggccuacuacuucucgcuuuaaucaccgccgcccucuacaaacuaggcuuuuucaaaagacaauacaaagacaugauguccgaaggaggcccacccggggccgaaccgcaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7129 - RNA, 1680 nt, Artificial Sequence
  mRNA product Design5 comprising derived and/or modified sequence from Homo sapiens__NP_002415.1__HsMMP8 (opt9)
gggagagucccgcagucggcguccagcggcucugcuuguucgugugugugucguugcaggccuuauucaagcuuaccauguucagccucaaaacgcuccccuuccuccuacuccuccacguccaaauaucuaaagccuuucccgucuccucuaaagaaaagaacacaaaaacaguacaagacuaccuggaaaaauucuaccaacucccauccaaccaauaccagucaacccgcaaaaacggcaccaacguaaucgucgaaaaacucaaagaaaugcaacgcuucuucggacucaacgucacugguaaaccaaacgaagaaacccucgacaugaugaaaaagccgagaugcggcguaccagacuccggcggcuuuaugcucacccccggaaacccgaaaugggaacgcaccaaccucaccuaccgcauacgaaacuacacaccccaacucucugaagccgaagucgaacgugccaucaaagacgccuucgaacucuggucaguagccuccccacucauuuucacacgaaucucccaaggugaagccgacaucaacaucgccuucuaccaacgagaccacggcgacaauucccccuuugacggcccaaacggaauacuagcccacgccuuccaacccggucaaggcaucggcggcgacgcccacuucgacgcagaagaaaccuggaccaauaccuccgcaaacuacaaccucuuccucgucgcagcccacgaauuuggacacucacucggccucgcacacucuagcgaccccggcgcccucauguaccccaacuacgccuuccgagaaaccuccaacuacucacucccgcaagacgacaucgauggaauccaagccaucuacggccucuccuccaacccaauccaacccacuggccccucaacccccaaacccugugacccaucccucacauucgacgccauuaccacccuccgcggggaaauccucuucuucaaagaucgcuacuucuggcgccgacacccccaacuacaacgcgucgaaaugaauuucaucucccucuucuggcccucccucccuaccggcauucaagccgccuacgaagacuucgaucgcgaccuuauuuuucucuuuaaaggcaaccaauacugggcccucucgggcuacgacauccuacaaggauaccccaaagacaucuccaacuacggauuccccucuuccguccaagcuauagacgccgccgucuucuaccgauccaagacauacuucuucgucaaugaccaauucuggcgauacgacaaccaacgacaguucauggaacccggguaccccaaauccauuuccggagccuucccaggcaucgaauccaaagucgacgccgucuuccagcaagaacacuucuuccacgucuucucaggcccccgcuacuacgccuucgaccuaaucgcccaacgcgucacccgcgucgcccgaggcaacaaauggcucaacugcagauacggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7130 - RNA, 2400 nt, Artificial Sequence
  mRNA product Design5 comprising derived and/or modified sequence from Homo sapiens__NP_004985.2__HsMMP9 (opt9)
gggagagucccgcagucggcguccagcggcucugcuuguucgugugugugucguugcaggccuuauucaagcuuaccaugagccuguggcaaccccucguccucguccuucuuguccucgguugcuguuucgccgcaccccgccaacgacaguccacccucguccucuuccccggagaccuccgcacaaaccuaacugaccgccagcucgccgaagaauaucuuuaccgcuacggcuacacccgcgucgcagaaaugagaggcgaauccaaaucucuggggcccgcccuccuccuccuccaaaaacagcucucccuccccgagaccggagaacuugacuccgccacccucaaagcaaugcgaacaccacgcugcggcgucccagaccucggccgcuuccaaacguucgaaggcgaccuaaaauggcaucaucacaacauuaccuacuggauccaaaacuacuccgaagaccucccccgcgccguaauagacgacgccuucgccagagccuucgcgcucugguccgccgucaccccacuaacauucacccgcgucuacucacgcgacgccgacauagugauucaauucggugucgcugaacacggggacggcuaccccuucgacggaaaagacggccuacuggcccacgcauucccacccggacccggaauccaaggugacgcccacuuugacgacgacgagcuuuggucccuaggaaagggcgucguagucccaacacgcuucggaaacgcagacggcgccgcuugccacuuccccuucauauucgaaggaagguccuacucagcaugcaccaccgacggccgaucagacggccucccguggugcucgaccacagcgaacuacgacacagaugaccgcuucggcuucugccccucagaacgacuauacacccaggacggcaacgccgacggaaaacccugccaauucccauucauauuccagggucagagcuacuccgccuguacgacggacggcagaagcgauggcuaccgcuggugcgcaaccacagcgaacuacgaccgagacaaacuuuucgguuucuguccaacccgcgcagacuccaccguaaugggcggcaacagcgccggagaacuaugcgucuucccauucaccuuccucggaaaagaauacuccacuuguaccucggaaggcagaggcgacggaagacucuggugugcuacaaccucaaacuucgacuccgacaagaaauggggcuucugccccgaucaaggcuacagucuauuccucgucgcagcccacgaguucggacacgcccucgggcucgaccacuccuccguacccgaagcgcuaauguacccaauguacagguuuaccgaaggaccaccccuacacaaagacgacgucaacggaauccgccaccuuuacggcccccgccccgaacccgaaccucguccacccaccacaacaacaccccaacccaccgcaccgccaaccguaugucccacggggcccccuaccguccacccgagcgaaagacccacagcaggcccuaccgguccacccucagcaggacccacaggacccccuacugccggccccucuacagccacuacugucccccuaagcccaguugacgacgcaugcaacguaaacauauuugacgcaaucgccgaaaucggcaaccaacuuuaccuauucaaagacgguaaauacuggcgauucuccgaaggacgcggaagucgcccccagggcccauuccuaaucgcagacaaauggccagcccuaccgagaaaacuagauucagucuucgaagaaagacuaagcaagaaacucuucuucuuuucuggccgacaaguauggguauacacaggagccagcguacuaggccccagaagacucgacaaacuaggccuaggagcagacguugcacaaguaaccggagcucuccguuccggcagaggcaaaaugcuauuguucucuggccgcagacuuuggcgcuucgacgucaaagcucaaaugguagacccccgauccgcauccgaggucgaccgcauguuccccggcguccccuuagacacacacgacguuuuccaguaccgagagaaagccuacuucugccaagaccgcuucuacuggagaguaagcagcagguccgaacucaaccaaguagaccaagucggauacguaacauacgacauccuccaaugcccagaagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7131 - RNA, 1692 nt, Artificial Sequence
  mRNA product Design5 comprising derived and/or modified sequence from Homo sapiens__NP_002418.1__HsMMP13 (opt9)
gggagagucccgcagucggcguccagcggcucugcuuguucgugugugugucguugcaggccuuauucaagcuuaccaugcaccccggaguccucgccgcauuccuauuccucuccuggacccacugccgagcccuaccccucccauccggcggagacgaagaugaccucuccgaagaagaccuccaauucgcagaacgcuaccuucgcuccuacuaccacccaaccaaucucgcaggcauccuaaaagaaaacgccgcauccucaaugaccgaacgccuccgagaaaugcaauccuucuucggccucgaagucaccggcaaacucgacgacaacacccucgacguaaugaaaaaaccuagaugcggagucccagacgucggagaauacaacguauucccccguacccugaaauggucaaaaaugaaccucacguacaggaucguaaacuacacccccgacaugacccauagcgaagucgaaaaagccuucaaaaaagccuucaaagucugguccgacgucacuccacuaaacuucacccgucuccacgacggcauagccgacaucaugauauccuucggaaucaaagagcacggcgacuucuaccccuucgacggacccagcggucuccucgcacacgccuuccccccgggccccaacuacggcggagacgcccacuucgaugacgacgagaccuggacauccuccucaaagggcuacaaccucuuccucgucgccgcccacgaauucgggcacucacuuggacucgaccauuccaaagaccccggagcccucauguucccaaucuacacauacaccggcaaaagucacuucaugcuccccgacgacgacguccaaggaauucaaagccucuacggccccggcgaugaagaccccaaccccaaacaucccaaaacacccgacaagugcgacccuucccucagccucgacgcaaucaccucacucagaggcgaaaccaugauauucaaagaccgauucuucuggcgacuccacccgcaacaaguagacgccgaacuauuccuaaccaaauccuucuggccagaacuaccuaaccgaaucgacgccgccuacgaacaccccagccacgaccucaucuucaucuuccgcggcagaaaauucugggcccucaacggcuacgacauccucgaaggcuaccccaaaaaaauaucugaacucggccucccaaaagaagucaaaaaaauauccgccgccguccacuucgaagacaccggcaaaacccuacucuuuagcggcaaccaagucuggcgauacgacgacacgaaccacaucauggacaaagacuacccucgccucaucgaagaagacuucccaggaaucggcgauaaaguagacgcgguuuacgaaaaaaacggcuacaucuacuucuucaacggcccaauacaauucgaauacuccauaugguccaaccgaauagucagagugaugccagcaaauucaauccucuggugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7132 - RNA, 1344 nt, Artificial Sequence
  mRNA product Design5 comprising derived and/or modified sequence from Homo sapiens__NP_001286.1__HsCCR1 (opt9)
gggagagucccgcagucggcguccagcggcucugcuuguucgugugugugucguugcaggccuuauucaagcuuaccauggaaacccccaacacaaccgaagacuacgacaccaccacggaguucgacuacggcgacgccacccccugccaaaagguaaacgaacgagccuucggcgcacaacuucucccaccccuguacucccuaguguucguaauaggccucgucggcaauauccuagucguauuaguccucguccaauacaaacgccucaagaacaugaccucuauauaccuacucaaccuagcaaucuccgaccuccuuuuccuguucacccuccccuucuggaucgacuauaaacucaaagacgauugggucuucggagacgccaugugcaaaauccucuccggcuucuauuauaccggucucuacuccgaaaucuucuucauaauccuccucaccaucgacagauaucucgccauaguccacgccgucuuugcacuccgcgcccgcaccgucaccuucggugucaucaccuccaucauaaucugggccuuagccauccucgccuccaugcccggacucuacuuuuccaaaacccaaugggaguucacccaccauaccugcucccuccacuucccccacgaaucccuacgcgaauggaaacucuuccaagcacuaaaacuaaaccucuuuggccucguccuuccccuccuagucaugaucaucugcuacacaggcaucaucaaaauccuacuucgucgcccuaaugaaaagaaauccaaagccguccgacucaucuucgucaucaugauaaucuuuuuccucuucuggacacccuauaaucucaccauccucaucucugucuuccaagacuuccucuucacacacgaaugcgaacaaucccgccaccuagaccucgccguccaagucaccgaagucaucgcauacacccacugcugcgucaaccccgucauauacgcauucgucggcgaacgcuuccgcaaguaccuccgccaacucuuccaccgacgcgucgcaguccaucucgucaaaugguuacccuuucucucugucgaccgccucgaacgcguauccucaacaucacccuccaccggcgaacaugaacuuucagccggcuucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7133 - RNA, 912 nt, Artificial Sequence
  mRNA product Design5 comprising derived and/or modified sequence from Homo sapiens__NP_002598.4__HsPDGFA (opt9)
gggagagucccgcagucggcguccagcggcucugcuuguucgugugugugucguugcaggccuuauucaagcuuaccaugcgaacccucgccugccuccuccuccucggcugcggcuaccucgcccacguacucgccgaagaagcagaaaucccccgcgaagucaucgaacgccucgcacgcucccaaauccacuccauccgugaccuccaacgacuccuggaaaucgacuccgucggauccgaagacucccuagacaccucccuaagagcccacggcguacacgccacaaaacacguccccgaaaaacgaccccuccccauccgcagaaaacgauccauagaagaagccguccccgccguaugcaaaacacgcacagucaucuacgaaauaccccgcucccaagucgacccaaccuccgccaacuuccuaaucuggccccccugcgucgaagucaaacgcugcaccggcugcugcaacaccuccucagucaaaugccaacccagccgcguccaccaccgcagcgucaaagucgcaaaagucgaauacguacgcaaaaaacccaaacucaaagaaguccaagucagacucgaagaacaccuagaaugcgcaugcgccaccaccagccuaaacccagacuaccgcgaagaagacaccggccgaccccgcgaauccggcaaaaaacgcaaacgcaaaagacuaaaacccaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7134 - RNA, 1002 nt, Artificial Sequence
  mRNA product Design5 comprising derived and/or modified sequence from Homo sapiens__NP_002599.1__HsPDGFB (opt9)
gggagagucccgcagucggcguccagcggcucugcuuguucgugugugugucguugcaggccuuauucaagcuuaccaugaaccgcugcugggcccuauuccuaagccuaugcugcuaccuccgccuagucucggccgagggcgaccccauccccgaagaacucuacgaaaugcucagcgaucacucaauccgcuccuucgacgaccuccaacgccuccuccacggcgaccccggcgaagaagacggagccgaacuagaccucaacaugacacgcucacacuccggaggggaacucgaaucccucgcacgcggccgccgcagccuaggcucacuaacaaucgccgaaccagcaaugaucgccgaaugcaaaacaagaacagaagucuucgaaaucucacgccgccuaaucgaccgcaccaacgccaacuuccuagucuggccacccugcgucgaaguccaaagaugcuccggaugcugcaacaacagaaacguccaaugccgccccacccaaguccaacuccgaccaguacaaguaagaaaaauagaaaucguccgcaaaaaacccaucuucaaaaaagcaaccguaacccucgaagaccaccucgcaugcaaaugcgaaaccgucgccgcagcccgccccgucacccgcagccccggcggaagccaagaacaacgagcaaaaacaccccaaaccagagucaccauccgaacaguccgcguacgcagaccccccaaaggaaaacaccgcaaauucaaacacacacacgacaaaaccgcccuaaaagaaacccuaggcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7135 - RNA, 1314 nt, Artificial Sequence
  mRNA product Design5 comprising derived and/or modified sequence from Homo sapiens__NP_057289.1__HsPDGFC (opt9)
gggagagucccgcagucggcguccagcggcucugcuuguucgugugugugucguugcaggccuuauucaagcuuaccaugucccucuucggccuacuccuccuaacaucugcacucgccggccaacgccaaggcacccaagccgaauccaaccucagcucuaaauuccaauucuccucaaacaaagaacaaaacggcguccaagacccccaacacgaacgcauaaucacagucucaaccaacggcuccauccauucaccccguuucccccacaccuacccccgcaacaccguccuaguauggcgccuaguagcaguagaggaaaacgucuggauccaacucaccuucgacgaacgcuuuggacucgaagauccagaagacgauaucugcaaauacgacuucgucgaaguagaagaaccuuccgacggcacaauccuaggccgauggugcggcuccggcaccgucccaggcaaacaaauauccaaaggcaaccaaauccgcauccgcuucgucuccgacgaauacuuccccuccgaacccggcuucugcauccacuacaacaucgucaugccccaauucaccgaagccgucucccccuccguccucccacccuccgcacucccccuagaccugcucaacaacgccaucaccgccuucucaacccucgaggaccucauacgcuaccuagagcccgaacgcuggcaacucgaccucgaagaccucuaccgcccaacauggcaacuccucggcaaagccuucgucuucggccgcaaaucccgcguagucgaccuaaaccuacuaaccgaagaaguacgccucuacagcugcacaccacgcaacuucucagucuccauccgcgaagaacucaaacgcaccgacaccaucuucuggccaggcugccuccuaguaaaacgcugcggcgggaacugcgccugcugccuccacaacugcaacgaaugccaaugcgucccauccaaagucaccaagaaauaccacgaagugcuacaacuaagaccaaaaaccggcguccgcggacuccacaaaucucucaccgacguagcccuagaacaccacgaagaaugcgacugcgucugccgcggcuccaccggcggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7136 - RNA, 1371 nt, Artificial Sequence
  mRNA product Design5 comprising derived and/or modified sequence from Homo sapiens__NP_149126.1__HsPDGFD (opt9)
gggagagucccgcagucggcguccagcggcucugcuuguucgugugugugucguugcaggccuuauucaagcuuaccaugcaccgccucauauuugucuacacacugauaugcgccaacuucuguucaugccgcgacaccuccgccaccccccaaucugccuccauaaaagcccucagaaacgccaaccuacgacgcgacgaccucuaccgacgcgacgaaacaauacaagucaaaggcaacggcuacguacaauccccacgcuuccccaacuccuacccccgcaaccuccuccucaccuggcggcuacacucccaagaaaacacccgcauacagcuuguauucgacaaccaauucggccuagaagaagccgagaacgacaucugccgauacgacuucgucgaagucgaagacaucagcgaaaccuccaccaucaucagaggaagauggugcggccacaaagaaguccccccucgaaucaaaucccgcacaaaccagauaaaaauaacauucaaauccgacgacuacuucgucgccaaacccggcuucaaaaucuacuacucccuccucgaagauuuccaacccgccgccgccuccgaaacaaacugggaauccgucaccuccuccauauccggugucucauacaacuccccaagcgucacagacccaacccucauugcagacgcacuagacaaaaaaaucgccgaauucgacaccgucgaggaccuccuaaaauacuucaaccccgaauccuggcaagaagaccucgaaaacauguaccucgacacaccccgcuacagaggccgcuccuaccacgaccgcaaauccaaggucgaccucgaccgccucaacgacgacgccaaacgcuacagcugcacaccccgcaauuacagugucaacaucagagaggaacuaaaacuagccaacguagucuucuucccacgcugccuacuaguacagcgaugcggcggcaacugcggcugcggcaccgugaacuggcgguccugcaccuguaacuccggcaaaacaguaaaaaaauaucacgaaguccuacaguuugaacccggacacaucaaacgccguggccgcgccaaaacuauggcccucguugacauccaacucgaccaccacgaacgcugcgacugcauaugcucuucccgcccaccccgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7137 - RNA, 954 nt, Artificial Sequence
  mRNA product Design5 comprising derived and/or modified sequence from Homo sapiens__NP_003946.3__HsSOCS3 (opt9)
gggagagucccgcagucggcguccagcggcucugcuuguucgugugugugucguugcaggccuuauucaagcuuaccauggucacccauucaaaauuccccgccgccggcaugucccgcccccucgacaccucccuccgccucaaaacauucuccuccaaauccgaauaccaacucgucgucaacgccguccgcaaacuccaagaauccggcuucuacuggucugccgucaccggaggcgaagccaaccuccuacuaucagccgaaccagcuggcaccuuccuaauccgugacuccuccgaccaacgccacuucuucacccucucagucaaaacccaauccggcaccaaaaaccuccgcauccaaugcgaaggcggauccuucucccuacaauccgacccccgcucaacucaaccagucccccgauucgacugcguccucaaacucguccaccacuacaugcccccacccggagcccccuccuuccccuccccacccaccgaacccuccuccgaaguccccgaacaacccuccgcccaaccccuccccggaucaccaccccgccgcgccuacuacaucuacuccggcggcgagaaaaucccccuaguccucucccgcccacucucauccaauguugccacccuacaacaccucugccguaaaaccguaaacggacaccuagacuccuacgaaaaaguuacccaacuacccggccccauccgcgaauuucucgaccaauacgaugcaccccucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7138 - RNA, 759 nt, Artificial Sequence
  mRNA product Design5 comprising derived and/or modified sequence from Homo sapiens__NP_003227.1__HsTGFA (opt9)
gggagagucccgcagucggcguccagcggcucugcuuguucgugugugugucguugcaggccuuauucaagcuuaccaugguccccuccgccggccaacuagcccucuucgcccuaggcaucguccucgcagccugucaagcacucgaaaacuccaccuccccccucucagccgacccacccguagccgcagccguagucucccacuucaacgacugccccgacucccacacccaauucugcuuccacggaaccugccgauuccucguccaagaagacaaacccgccugcguaugccacuccggcuacgucggcgcccgcugcgaacacgccgaccuccuagccguaguagccgccucacaaaaaaaacaagccauaaccgcacucguagucgucuccaucgucgcccucgccguccuuauaauaaccugcguccucauccacugcugccaaguacgcaaacacugcgaauggugccgcgcccucaucugcagacacgaaaaacccuccgcacuacucaaaggccgcaccgccugcugccauuccgaaaccguaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7139 - RNA, 1449 nt, Artificial Sequence
  mRNA product Design5 comprising derived and/or modified sequence from Homo sapiens__NP_000651.3__HsTGFB1 (opt9)
gggagagucccgcagucggcguccagcggcucugcuuguucgugugugugucguugcaggccuuauucaagcuuaccaugccaccauccggccuacgucuccucccucuccuccugccacuccucuggcuauuaguccuaacaccaggccgcccagccgccggccucucaaccugcaaaacuaucgacauggaacuugucaaacgcaaacgaauagaagccauccgcggccaaauccuauccaaacuccgccucgccuccccacccucacaaggcgaaguaccacccggaccccuacccgaagccguccuugcacucuauaacuccacccgcgaccgaguugcuggagaaucagccgaacccgaaccagagccagaagccgacuacuacgccaaagaagucacccgcguacucauggucgaaacacacaacgagauauacgauaaauucaagcaauccacccacuccauauacauguucuucaacaccucagaacuacgagaagccguccccgaacccguccuacuaucacgagccgaacuucgucuccuccgacucaaacucaaggucgaacaacacgucgaacucuaccaaaaauauucaaacaacucauggcgcuaccuaucaaaccgccuacuagcaccaucagacucacccgaauggcuaucauucgacgucaccggagucguccgccaauggcuaucacgaggaggcgaaaucgaaggcuucagacucucagcccacugcuccugcgacucccgagacaacacccuccaagucgacaucaacggcuucaccaccggccgacgcggagaccucgccacaauacacggaaugaaccgacccuuccuacuccucauggcaacaccacucgaacgcgcccaacaccuccaaucuucccgccaccgccgagcccuggacaccaacuacugcuucuccuccacugagaaaaauugcugcgugagacaacucuacaucgacuuccgcaaagaccucggcuggaaauggauccacgaaccaaaaggcuaccacgcaaacuucugccucggccccugcccauacauauggucccuagacacccaauacuccaaaguucuagcccuauacaaccaacacaaccccggcgccuccgcggcucccugcugcguuccccaagcccucgaaccccucccaauagucuacuacgucggccgcaaaccaaaagucgaacaacucuccaacaugaucguccgauccugcaaaugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7140 - RNA, 1521 nt, Artificial Sequence
  mRNA product Design5 comprising derived and/or modified sequence from Homo sapiens__NP_003229.1__HsTGFB2 (opt9)
gggagagucccgcagucggcguccagcggcucugcuuguucgugugugugucguugcaggccuuauucaagcuuaccaugcacuacugcguacucucagccuuccucauccuccaccucgucaccgucgcacuaucacuaucuaccugcagcacacucgauauggaccaauucaugcgcaaacgcauagaagcuauccguggccaaauccuauccaaacucaagcucaccagcccacccgaagacuauccugaacccgaagaagucccacccgaaguaaucuccaucuacaacuccacacgcgaccuccuacaagaaaaagccucccgacgcgcagccgccugcgaacgagagcgcuccgacgaagaauacuacgccaaagaaguauacaagauagacaugccacccuucuucccuuccgaaaacgccauacccccaaccuucuaccgcccauacuuccgcaucguccgcuucgacgucucugcuauggagaaaaaugcauccaaccucgucaaagccgaguuccgcguauuccgccuacaaaaccccaaagcgcgcgucccugaacaacgcaucgaacucuaccagauccucaaauccaaagaucuuaccucgcccacacaacgcuacaucgacuccaaagucguaaagacccgcgccgaaggagaauggcucuccuucgacguaaccgacgccguccacgaauggcuacaccacaaagaccgcaaccucggcuucaaaaucucccuacacugccccugcugcaccuucguccccuccaacaauuacaucauccccaauaaauccgaagaacucgaagccagauucgccggcaucgacggcaccucaaccuacacauccggcgaccagaaaaccaucaaaucaacccgcaagaaaaacuccggcaaaaccccacaucuccuccucaugcuucucccuucauaccgucucgaaucucaacaaaccaaccgacgcaagaaacgcgcccucgacgccgccuacuguuuccgcaacguccaagacaacugcugccuacgaccccucuacauagacuucaaacgcgaccucggcuggaaauggauccacgaacccaaaggcuacaacgcuaacuucugcgcgggcgccugccccuaccuaugguccuccgacacccaacacucacgcguccucucccucuacaacaccaucaauccugaagccuccgccucacccugcugcgucucccaagaccucgaaccacucaccauacuauacuacaucggcaaaacgccuaaaauagaacaacuaucuaacaugaucgucaaauccuguaaaugcagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7141 - RNA, 1515 nt, Artificial Sequence
  mRNA product Design5 comprising derived and/or modified sequence from Homo sapiens__NP_003230.1__HsTGFB3 (opt9)
gggagagucccgcagucggcguccagcggcucugcuuguucgugugugugucguugcaggccuuauucaagcuuaccaugaaaaugcaccuccaacgcgcccuagucguacucgcacuacucaacuuugccaccguaucacuuucacucuccacaugcaccacacucgacuuuggccacaucaaaaagaaacgagucgaagcuauacgaggccaaauccuaucaaaacuacgccucacauccccacccgaacccacaguaaugacccacguccccuaccaaguacucgcccuauacaacuccacccgcgaacuccuagaagaaaugcacggagaaagagaagaaggaugcacccaggaaaacaccgaaucagaauacuacgccaaagaaauacacaaauucgacaugauccaaggccucgccgaacacaacgaauuagccgucugccccaaagguaucacuagcaaaguauuccgauucaacguuuccucggucgagaaaaaccgcaccaaccuauuccgagccgaguuccguguccuccgcguccccaacccaagcucaaaacgcaacgaacaacgcaucgaacuuuuccaaauacuaagacccgacgaacacaucgccaaacaacgcuacauaggcggcaaaaaccucccaacccgcggcaccgcagaauggcucucuuucgacgucaccgacaccguacgugaauggcuacucagacgcgaauccaaccuaggucuagaaaucucaauacacugccccugccacaccuuccaaccaaacggagacauccucgaaaacauccacgaagucauggaaaucaaauucaaaggagucgacaaugaagacgaccacggacgaggcgaccucggacgacucaaaaagcaaaaagaccaccacaacccccaccucauccuaaugaugaucccaccccaccgccucgacaaccccggacaaggcggccaacgcaagaaacgcgcccucgacaccaacuacugcuuccgcaaccuagaagaaaacugcugcguacgcccccucuacaucgacuuccgacaagaccuaggcuggaaauggguccacgaacccaaaggauacuacgcaaauuucugcagcggaccaugcccauaccuacgguccgccgacacaacccacuccacaguccuaggacuuuauaacacccuaaacccagaagccuccgccucccccugcugugucccccaagaccuugaaccucucaccauccuuuacuacgucggcagaacccccaaagucgaacaacuauccaacauggucgucaaauccugcaaaugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7142 - RNA, 1662 nt, Artificial Sequence
  mRNA product Design5 comprising derived and/or modified sequence from Homo sapiens__NP_001057.1__HsTNFRSF1B (opt9)
gggagagucccgcagucggcguccagcggcucugcuuguucgugugugugucguugcaggccuuauucaagcuuaccauggcacccguugcagucugggcagcccuugccgucggccucgaacucugggccgcugcccacgcccuccccgcccaaguugccuucacuccuuacgccccagaaccaggcuccacaugccgacuccgagaauacuaugaccaaacagcccaaaugugcugcuccaagugcucccccggccaacacgccaaagucuucuguaccaaaaccucugacaccgucugcgacuccugcgaagacuccacuuacacccaacuauggaacuggguacccgaaugccucuccugcggcuccagaugcucauccgaccaagucgaaacccaagcaugcacacgcgaacaaaaccgaaucugcacaugcaggcccggaugguacugcgcacucuccaaacaagaaggcugccgccucugcgcaccccuccgaaaaugccgaccaggcuucggcgucgcccgcccaggaacagaaaccuccgacguagucugcaaacccugcgccccuggcacuuucuccaacacaaccagcucaaccgacauaugccgcccacaccaaaucugcaacgucguugcaauacccggcaacgcauccauggacgccgucugcaccuccacaucgcccacccgauccauggcacccggcgccguccaccucccccaaccugucucaacccgaucacaacacacacaacccacccccgaacccucaaccgccccauccaccucauuccuucuacccaugggccccuccccacccgccgaaggcuccaccggagacuucgcccucccagucggccuaaucgucggcgucaccgcccuaggccugcucaucaucggagucgucaacugcguaaucaugacccaagucaaaaagaagccccuaugucuccaaagagaagcaaaaguaccucaccuccccgccgacaaagcccgcggcacacaaggccccgaacaacaacaccuccuaaucaccgccccaucauccuccucaucaagccucgaaucaucagcaucagcucucgaccgccgcgccccaaccagaaaccaaccccaggccccaggcguagaagccuccggagccggagaagcccgagccucaacaggcuccuccgacagcucucccggcggccacggcacacaaguaaacguaaccugcaucgucaauguaugcucgucauccgaccauuccucccaaugcucaagccaagccucaucaaccaugggcgacaccgacucaagcccaucugaaucccccaaagacgaacaaguacccuucaguaaagaagaaugugccuuccgaucccaauuagaaacccccgaaacacuccuaggauccaccgaagaaaaacccuuaccccucggugucccagacgccggcaugaaacccuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7143 - RNA, 789 nt, Artificial Sequence
  mRNA product Design5 comprising derived and/or modified sequence from Homo sapiens__NP_002623.2__HsPGF (opt9)
gggagagucccgcagucggcguccagcggcucugcuuguucgugugugugucguugcaggccuuauucaagcuuaccaugccggucaugcgcuuguucccgugcuuucuacagcucuuggcagggcucgcacucccagccgugcccccgcaacagugggcguuaucggccgggaacgggagcucggaaguggaagugguaccguuccaggaagugugggggcgcucguacugucgcgcgcuagagcgccuggucgaugucgugagugaguacccgagcgaggucgagcacauguucucgcccucaugcgugagcuugcucaggugcacgggcuguugcggggacgagaaccugcacugugucccggucgagaccgcgaacgugaccaugcaauugcucaagaucaggagcggggacaggcccucguacguggaauugaccuucagccagcacguacgcugugaaugucgcccacucagggaaaagaugaagccagaacgcaggcgaccgaaagggcgcgggaaaaggcgcagagaaaagcaaaggcccacagacugucacuuaugcggggacgcggucccgaggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7144 - RNA, 1515 nt, Artificial Sequence
  mRNA product Design5 comprising derived and/or modified sequence from Homo sapiens__NP_001020537.2__HsVEGFA (opt9)
gggagagucccgcagucggcguccagcggcucugcuuguucgugugugugucguugcaggccuuauucaagcuuaccaugacagaccgccagacagacaccgcgccaucgcccucguaccaccuccugcccgggagaaggcgcacggucgacgccgcagccucgcgaggacaagggcccgagccagcgccaggaggcgggguagagggcgugggagcgcgaggggucgcgcucaaacucuucguccagcuucugggcugcagcagguucgggggcgcaguagugcgcgcaggcgaagccgagcccucaggcgcggccaggagcgcaagcucaggcagagaggaaccccagcccgaggagggggaagaagaagaggaaaaagaagaagaaagggguccacaauggcgccugggcgcgcgcaagccaggaaguuggaccggagaagcagcagugugcgcggacucugcaccagccgcgcgagcgccccaggcauuggccagagcaucaggcagaggaggacgaguggcaagaagaggagccgaggaaucaggaccgccccauagcccaagcaggcgagggagugcgagcagagccggaccagggcgcgcaagcgagacaaugaacuuccuccugagcuggguacacuggucgcuagcacuguugcucuaccuccaucacgcaaaauggagccaggccgcgccaauggccgagggaggaggacaaaaccaccacgagguagugaaauucauggacgucuaccaaaggagcuauugccaccccauagaaacgcuaguggacauauuccaggaauauccagacgaaauagaguacauauucaaaccaagcugcgugccgcucaugaggugcggcggaugcuguaacgaugaagggcuagagugcguacccacggaagagagcaacaucaccaugcagaucaugaggauaaaaccgcaccagggccagcacauaggagagaugucauuccugcaacacaacaagugcgagugccggcccaagaaagaccgagcaagacaggaaaagaaaucaguaaggggaaagggcaagggacagaaaagaaaaagaaagaagaguagguacaagagcuggaguguauacguaggggcgagaugcugccugaugccauggagccuaccgggaccgcacccaugcggacccugcagcgaacgcaggaaacaccuguucguccaggacccacaaacaugcaaguguucaugcaagaacacagacucgcgcuguaaagcacgccaacucgagcuuaacgaaaggacaugccgcugcgacaaacccaggagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7145 - RNA, 975 nt, Artificial Sequence
  mRNA product Design5 comprising derived and/or modified sequence from Homo sapiens__NP_001165094.1__HsVEGFA (opt9)
gggagagucccgcagucggcguccagcggcucugcuuguucgugugugugucguugcaggccuuauucaagcuuaccaugaacuuccuacucagcuggguccacuggucacucgcccuccuccucuaccuccaccacgccaaauggucccaagccgcccccauggccgaaggcggcggccaaaaccaccacgaaguaguaaaauucauggacguauaccaacgcagcuacugccaccccaucgaaacccuaguagacaucuuccaagaauaccccgacgaaaucgaauacauauucaaacccuccugcgucccacucaugcgcugcggcggcugcugcaacgacgaaggccucgaaugcguccccacagaagaaagcaacaucacaaugcagauaaugcgaaucaaaccccaccaaggccagcacaucggcgaaaugucauuccuccaacacaacaaaugcgaaugccgaccaaaaaaagaccgcgcaagacaagaaaaaaaauccgucagaggcaaaggcaaaggccaaaaacgaaaacgcaaaaaaucccgcuacaaaagcuggucagucuacguaggcgcccgcugcugccucaugccauggucccuccccggcccccaccccugcgggcccugcagcgaacgccgcaaacaccucuucguccaagacccacaaaccugcaaaugcuccugcaaaaacaccgacucccgcugcaaagcccgccaacucgaacuaaacgaacgcaccugccgcugcgacaaaccccgaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7146 - RNA, 900 nt, Artificial Sequence
  mRNA product Design5 comprising derived and/or modified sequence from Homo sapiens__NP_003368.1__HsVEGFB (opt9)
gggagagucccgcagucggcguccagcggcucugcuuguucgugugugugucguugcaggccuuauucaagcuuaccauguccccccuccuccgccgacuccuacuagccgcccuccuacaacucgcccccgcacaagcccccgucucccaacccgacgcccccggccaccaacgcaaagucguauccuggauagacguauacacccgcgccaccugccaaccacgagaagucguagucccacucacagucgaacucaugggcaccgucgcaaaacaacucguaccaucaugcguaaccguccaacgaugcggcggcugcugccccgacgacggccuagaaugcguccccaccggccaacaccaagucagaaugcaaauccucaugauccgcuaccccuccucccaacucggcgaaaugucacucgaagaacacucccaaugcgaaugccgccccaaaaaaaaagacucagccguaaaacccgaccgcgccgccacaccacaccaccgaccccaaccccgcucagucccaggcugggacuccgcccccggcgcacccucccccgccgacaucacccaccccacccccgcacccggccccuccgcacacgccgccccauccaccaccuccgcccucacccccggccccgccgccgccgccgccgacgccgccgccagcuccgucgcaaaaggcggcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7147 - RNA, 1536 nt, Artificial Sequence
  mRNA product Design5 comprising derived and/or modified sequence from Homo sapiens__NP_005420.1__HsVEGFC (opt9)
gggagagucccgcagucggcguccagcggcucugcuuguucgugugugugucguugcaggccuuauucaagcuuaccaugcaccuccucggauucuucuccgucgccugcucccuacucgccgccgcacuccuccccggcccacgcgaagcaccagcagccgccgccgcauucgaaucaggccucgaccuauccgacgccgaaccagacgccggcgaagccaccgccuaugcaagcaaagaccucgaagaacaacuacgauccguaucauccguggacgaacuaaugaccguccucuacccagaauacuggaaaauguacaaaugccaacuccgaaaaggcggauggcaacauaaccgcgaacaagccaaccucaacagccgaaccgaagaaacaaucaaauucgccgccgcccacuacaacacggaaauacuaaaauccaucgacaacgaauggagaaaaacacaaugcaugccccgugaagucugcaucgacgucggcaaagaauuuggcgucgccaccaacacauucuucaaaccacccugcgucucaguauaccgaugcggcgggugcugcaacuccgaaggccuacaaugcaugaacaccuccaccucauaccucucaaaaacccucuucgaaauaacaguuccacucagccaaggccccaaacccgucacgauauccuucgcaaaccauacuucaugccgcugcaugucaaaacuugacguauaccgccaaguccacuccaucauccgaagaucacuacccgccacccuaccccaaugucaagccgccaacaaaaccugccccaccaacuacauguggaacaaccacauuugccgcugccuagcccaagaagacuucauguucucaucggacgccggcgacgacucaaccgacggcuuccacgacauaugcggccccaacaaagaacuagacgaagaaacaugccaaugcgucugccgcgccggccuccgacccgcauccugcggaccccacaaagaacuggaccgcaacucaugccaaugcgucugcaaaaacaaacucuuccccucccaaugcggcgcaaaccgcgaguucgacgaaaauaccugccaaugcgucugcaagcgaaccugcccacgcaaccaaccccucaaccccggaaagugcgccugcgaaugcaccgaaagcccacaaaaaugccuucucaaaggaaagaaauuccaccaccaaaccugcucaugcuaccgccgccccugcaccaaccgccaaaaagccugcgaacccggcuucucauacuccgaagaaguaugccgcugcguuccaagcuacuggaaacgcccccaaauguccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7148 - RNA, 1341 nt, Artificial Sequence
  mRNA product Design5 comprising derived and/or modified sequence from Homo sapiens__NP_004460.1__HsVEGFD (opt9)
gggagagucccgcagucggcguccagcggcucugcuuguucgugugugugucguugcaggccuuauucaagcuuaccauguaccgagaauggguagucgucaacgucuucaugaugcucuacguccaacugguccaagguucauccaacgaacauggccccgucaaacgcuccucccagagcacccucgagcgcuccgaacaacaaauccgcgcugccuccucucuagaagaacuucuccgaaucacccacucugaagacuggaaauuauggcgaugccgccuacgucucaagagcuucaccucaauggacucccgauccgcaucccaccgcucuacacgauucgccgccaccuucuacgacaucgaaacccucaaagucauagacgaagaauggcaacgcacccaaugcuccccaagggaaaccugcgucgaaguagccuccgaacucggcaaauccaccaacacauucuucaaaccucccugcgucaacgucuuccgcugcggcggcugcugcaacgaagaaucccucaucugcaugaacacauccaccuccuacauauccaaacaacuauucgaaauuucugucccccucaccucgguccccgaacucguccccgucaaaguagccaaccacaccggcugcaaaugccugcccaccgccccacgacaccccuauuccaucauccgacgcuccauacagauucccgaagaagaccgaugcucccacucaaagaaacucugccccauagacaugcuaugggacucaaacaaaugcaaaugcguccuccaagaagaaaacccacucgccggcacugaagaccacucgcaccuccaagaacccgcccucugcggaccccacaugauguucgacgaagaccgcugcgaaugcgucugcaaaaccccaugccccaaagaccucauccaacaccccaaaaacugcucaugcuucgaaugcaaagaaucccucgagaccugcugccaaaaacacaaacucuuccaccccgauaccugcuccugcgaagaccgcugccccuuccacacacgcccaugcgccuccggcaaaaccgcaugcgcaaaacacugccguuucccaaaagaaaaacgcgccgcccaaggcccccacucccgcaaaaaccccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7149 - RNA, 906 nt, Artificial Sequence
  mRNA product Design5 comprising derived and/or modified sequence from Homo sapiens__NP_061986.1__HsFGF21 (opt11)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7150 - RNA, 1686 nt, Artificial Sequence
  mRNA product Design5 comprising derived and/or modified sequence from Homo sapiens__NP_002412.1__HsMMP1 (opt11)
gggagagucccgcagucggcguccagcggcucugcuuguucgugugugugucguugcaggccuuauucaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7151 - RNA, 1446 nt, Artificial Sequence
  mRNA product Design5 comprising derived and/or modified sequence from Homo sapiens__NP_002412.1__HsMMP1(1-19,100-469) (opt11)
gggagagucccgcagucggcguccagcggcucugcuuguucgugugugugucguugcaggccuuauucaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7152 - RNA, 3633 nt, Artificial Sequence
  mRNA product Design5 comprising derived and/or modified sequence from Clostridium histolyticum__BAA77453.1__ColG (opt11)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7153 - RNA, 3357 nt, Artificial Sequence
  mRNA product Design5 comprising derived and/or modified sequence from Clostridium histolyticum__BAA77453.1__HsALB(1-18)_ColG(111-1118) (opt11)
gggagagucccgcagucggcguccagcggcucugcuuguucgugugugugucguugcaggccuuauucaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7154 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt11)
gggagagucccgcagucggcguccagcggcucugcuuguucgugugugugucguugcaggccuuauucaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7155 - RNA, 3381 nt, Artificial Sequence; identical to SEQ ID NO: 6327
  mRNA product Design5 comprising derived and/or modified sequence from Clostridium histolyticum__BAA34542.1__ColH (opt11)

SEQ ID NO: 7156 - RNA, 3342 nt, Artificial Sequence; identical to SEQ ID NO: 5817
  mRNA product Design5 comprising derived and/or modified sequence from Clostridium histolyticum__BAA34542.1__ColH (opt11)

SEQ ID NO: 7157 - RNA, 3276 nt, Artificial Sequence
  mRNA product Design5 comprising derived and/or modified sequence from Clostridium histolyticum__BAA34542.1__HsALB(1-18)_ColH(41-1021) (opt11)
gggagagucccgcagucggcguccagcggcucugcuuguucgugugugugucguugcaggccuuauucaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7158 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt11)
gggagagucccgcagucggcguccagcggcucugcuuguucgugugugugucguugcaggccuuauucaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7159 - RNA, 852 nt, Artificial Sequence
  mRNA product Design5 comprising derived and/or modified sequence from Homo sapiens__NP_001133.1__HsAMELX (opt11)
gggagagucccgcagucggcguccagcggcucugcuuguucgugugugugucguugcaggccuuauucaagcuuaccaugggcaccuggauacuauucgccugccuccucggcgccgccuucgccaugccccuacccccccaccccggccaccccggcuacaucaacuucucauacgaaguccucaccccccucaaaugguaccaaucaauccgcccccccuaccccuccuacggcuacgaacccaugggaggcuggcuccaccaccaaaucauccccguccucucccaacaacacccccccacccacacccuccaaccccaccaccacauccccgucguccccgcccaacaacccgucaucccccaacaacccaugaugcccguccccggccaacacucaaugacccccauccaacaccaccaacccaaccuccccccccccgcccaacaacccuaccaaccccaacccguccaaccccaaccacaccaaccaaugcaaccccaaccccccguccaccccaugcaaccccuccccccccaacccccccuaccccccauguuccccaugcaaccccucccccccaugcuccccgaccucacccucgaagccuggcccuccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7160 - RNA, 411 nt, Artificial Sequence
  mRNA product Design5 comprising derived and/or modified sequence from Homo sapiens__NP_001133.1__HsAMELX-TRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccauccgcccccccuaccccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7161 - RNA, 444 nt, Artificial Sequence
  mRNA product Design5 comprising derived and/or modified sequence from Homo sapiens__NP_001133.1__HsAMELX-LRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7162 - RNA, 483 nt, Artificial Sequence
  mRNA product Design5 comprising derived and/or modified sequence from Homo sapiens__NP_001133.1__HLA-A2-SP_HsAMELX(17-60) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccauccgcccccccuaccccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7163 - RNA, 516 nt, Artificial Sequence
  mRNA product Design5 comprising derived and/or modified sequence from Homo sapiens__NP_001133.1__HLA-A2-SP_HsAMELX(17-47,168-191) (opt11)
gggagagucccgcagucggcguccagcggcucugcuuguucgugugugugucguugcaggccuuauucaagcuuaccauggccgucauggccccccgcacccucguccuacuccucuccggcgcccucgcccucacccaaaccugggccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7164 - RNA, 855 nt, Artificial Sequence
  mRNA product Design5 comprising derived and/or modified sequence from Homo sapiens__NP_001134.1__HsAMELY (opt11)
gggagagucccgcagucggcguccagcggcucugcuuguucgugugugugucguugcaggccuuauucaagcuuaccaugggcaccuggauccucuucgccugccucgucggcgccgccuucgcaaugccccuccccccccaccccggccaccccggcuacaucaacuucuccuacgaaguccucaccccacucaaaugguaccaauccaugauccgcccacccuacucauccuacggcuacgaaccaaugggcggcuggcuccaccaccaaaucauccccgucguaucccaacaacacccccucacccacacccuccaaucccaccaccacauccccgucguccccgcacaacaaccccgcguccgccaacaagcccucaugcccguccccggccaacaauccaugacccccacccaacaccaccaacccaaccucccccuccccgcccaacaacccuuccaaccccaacccguccaaccccaaccccaccaacccaugcaaccccaacccccaguccaacccaugcaaccccuccucccccaacccccccucccccccauguucccacuccgaccccucccccccauccuacccgaccuccaccuugaagccuggcccgccaccgacaaaaccaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7165 - RNA, 414 nt, Artificial Sequence
  mRNA product Design5 comprising derived and/or modified sequence from Homo sapiens__NP_001134.1__HsAMELY-TRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7166 - RNA, 447 nt, Artificial Sequence
  mRNA product Design5 comprising derived and/or modified sequence from Homo sapiens__NP_001134.1__HsAMELY-LRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7167 - RNA, 486 nt, Artificial Sequence
  mRNA product Design5 comprising derived and/or modified sequence from Homo sapiens__NP_001134.1__HLA-A2-SP_HsAMELY(17-61) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7168 - RNA, 519 nt, Artificial Sequence
  mRNA product Design5 comprising derived and/or modified sequence from Homo sapiens__NP_001134.1__HLA-A2-SP_HsAMELY(17-48,169-192) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7169 - RNA, 846 nt, Artificial Sequence
  mRNA product Design5 comprising derived and/or modified sequence from Sus scrofa__NP_999071.1__SsAMELX-001-1 (opt11)
gggagagucccgcagucggcguccagcggcucugcuuguucgugugugugucguugcaggccuuauucaagcuuaccaugggcaccuggauccucuucgccugucuccucggcgccgccuucuccaugccccuccccccccaccccggccaccccggcuacaucaacuucuccuacgaaguccucaccccccucaaaugguaccaaaacaugauccgacaccccuacaccuccuacggcuacgaacccaugggcggcuggcuccaccaccaaaucauccccgucgucucccaacaaaccccccaaucccacgcccuucaaccccaccaccacauccccaugguccccgcccaacaacccggcauaccccaacaacccaugaugccccucccuggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuccucccccaaccaccccuaccccccauguucuccaugcaaucccuccuccccgaccucccccucgaagccuggcccgccaccgacaaaacaaaacgugaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7170 - RNA, 414 nt, Artificial Sequence
  mRNA product Design5 comprising derived and/or modified sequence from Sus scrofa__NP_999071.1__SsAMELX-TRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7171 - RNA, 447 nt, Artificial Sequence
  mRNA product Design5 comprising derived and/or modified sequence from Sus scrofa__NP_999071.1__SsAMELX-LRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7172 - RNA, 486 nt, Artificial Sequence
  mRNA product Design5 comprising derived and/or modified sequence from Sus scrofa__NP_999071.1__HLA-A2-SP_SsAMEL(17-61) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7173 - RNA, 519 nt, Artificial Sequence
  mRNA product Design5 comprising derived and/or modified sequence from Sus scrofa__NP_999071.1__HLA-A2-SP_SsAMEL(17-49,167-189) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7174 - RNA, 810 nt, Artificial Sequence
  mRNA product Design5 comprising derived and/or modified sequence from Sus scrofa__P45561-2__SsAMELX-001-2 (opt11)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggauacaucaacuucuccuacauccgacaccccuacaccuccuacggcuacgaacccaugggcggcuggcuccaccaccaaaucauccccgucgucucccaacaaaccccccaaucccacgcccuccaaccacaccaccacauccccaugguccccgcccaacaacccggcaucccccaacaacccaugaugccccuccccggccaacacuccaugacccccacccaacaccaccaacccaaccucccccuucccgcccaacaacccuuccaaccccaacccguccaaccccaaccccaccaaccccuacaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7175 - RNA, 846 nt, Artificial Sequence
  mRNA product Design5 comprising derived and/or modified sequence from Sus scrofa__NP_998965.1__SsAMELX-001-3 (opt11)
gggagagucccgcagucggcguccagcggcucugcuuguucgugugugugucguugcaggccuuauucaagcuuaccaugggcaccuggaucuucuucgccugccuccucggcgccucccucgccaugccccucccaccccaccccggccaccccggcuacaucaacuucuccuacgaaguccucacaccccucaaaugguaccaaaacaugauccgccaccccuacaccuccuacggcuacgaacccaugggcggcuggcuccaccaccaaaucauccccgucgucucucaacaaacaccccaaucccacgcccuccaaccccaccaccacauccccaugguccccgcccaacaacccggcauaccccaacaacccaugaugccccuccccggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuacucccccaaccaccccuaccacccauguucuccaugcaaucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7176 - RNA, 495 nt, Artificial Sequence
  mRNA product Design5 comprising derived and/or modified sequence from Sus scrofa__K7GPB2__SsAMELX-002 (opt11)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7177 - RNA, 888 nt, Artificial Sequence
  mRNA product Design5 comprising derived and/or modified sequence from Sus scrofa__K7GLD0__SsAMELX-003 (opt11)
gggagagucccgcagucggcguccagcggcucugcuuguucgugugugugucguugcaggccuuauucaagcuuaccaugggcaccuggauccucuucgccugccuccucggagccgccuucuccaugccccuacccccccaccccggccaccccggcuacaucaacuucuccuacgaagaccuuuaccucgaagccauccgcaucgaccgcaccgccuucguccucaccccccuaaaaugguaccaaaacaugauccgccaccccuacaccuccuacggcuacgaacccaugggcggcuggcuccaccaccaaaucauccccgucgucucccaacaaaccccccaaucccacgcccuccaaccccaccaccacauccccaugguccccgcccaacaacccggcaucccccaacaacccaugaugccccuccccggccaacacuccaugacccccacccaacaccaccaacccaaccucccccuccccgcccaacaacccuuccaaccccaacccguacaaccccagccccaccaaccccuucaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7178 - RNA, 774 nt, Artificial Sequence
  mRNA product Design5 comprising derived and/or modified sequence from Sus scrofa__K7GPE9__SsAMELX-004 (opt11)
gggagagucccgcagucggcguccagcggcucugcuuguucgugugugugucguugcaggccuuauucaagcuuaccaugggaaccuggauccucuucgccugccuccucggcgcagccuucuccaugccccuccccccccaccccggccaccccggcuacaucaacuucuccuacgaaguccucaccccccuaaaaugguaccaaaacaugauccgccaccccacaccccaaucacacgcccuccaaccccaccaccacauccccaugguccccgcacaacaacccggcaucccccaacaacccaugaugccccuccccggccaacacuccaugacacccacccaacaccaccaacccaaccuaccccuccccgcccaacaacccuuccaaccccaacccguccaaccccaaccccaccaaccccuccaaccccaaucccccaugcaccccauccaaccccuccucccccaacccccccucccacccauguucuccaugcaaucccuccuccccgaccucccacucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7179 - RNA, 798 nt, Artificial Sequence
  mRNA product Design5 comprising derived and/or modified sequence from Sus scrofa__J9JIM4__SsAMELX-201 (opt11)
gggagagucccgcagucggcguccagcggcucugcuuguucgugugugugucguugcaggccuuauucaagcuuaccaugccccuacccccacaccccggccaccccggcuacaucaacuucuccuacgaaguccucaccccacucaaaugguaccaaaacaugauccgccaccccuacaccuccuacggcuacgaacccaugggcggcuggcuccaccaccaaaucauccccgucgucucccaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuccccgcccaacaacccuuccaaccccaaccaguccaaccccaaccccaccaaccccuccaaccccaaucccccaugcacccaauccaaccccuacucccccaaccuccccuaccacccauguucuccaugcaaucccuccuccccgaccucccccucgaagccuggcccgccaccgacaaaaccaaacgcgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7180 - RNA, 3237 nt, Artificial Sequence
  mRNA product Design5 comprising derived and/or modified sequence from Homo sapiens__NP_006120.1__HsBMP1 (opt11)
gggagagucccgcagucggcguccagcggcucugcuuguucgugugugugucguugcaggccuuauucaagcuuaccaugccaggaguugcccgccuaccacuacuacuaggucuccucuuacucccgcgacccggccgcccacucgaccuagcagacuacacauacgaccucgcagaagaagacgacucagaaccacuaaacuacaaagaucccugcaaagccgcggcauuccucggagacauagcccuggacgaagaagaucuacgagcauuccagguccaacaagcaguagaccuccggcgacacacagcucgcaaaucguccaucaaagcggccgucccaggcaacacaaguaccccuuccugccaguccaccaacggucaaccccaacggggagccugcggacgcuggcguggcaggucacgaucccggcgagcagccaccagcagaccggaacgaguauggcccgacggggucaucccauucguaaucggugggaacuucacgggaucgcaacgagcaguauuccgacaggccaugcgccacugggaaaaacacacaugcgucaccuuccucgaacgcacagacgaagacagcuacauagucuucacauacagaccaugcggaugcugcaguuacgucggacggagaggcggcggcccgcaagcaauaucgauagggaaaaacugcgacaaauucggcauagucguccacgaacuagggcaugucguaggguucuggcacgagcacaccaggcccgaccgagaccgccacguaagcauaguccgcgaaaacauccaacccggacaggaauacaacuuccucaagauggaaccccaagaagucgagucgcugggggaaacauacgacuucgacuccauaaugcacuacgcccgaaacaccuucagccgagguaucuuccucgacacaaucguccccaaguacgaagucaacggcgucaaacccccaauaggccaacggacccgacucucaaaaggugacaucgcucaggcccgcaaacuguauaagugccccgccuguggggagacccuacaggacagcacgggcaacuucagcuccccugaauaccccaacggcuacagcgcacacaugcacugcgucuggcgcaucagugucaccccaggagagaaaaucauccucaacuucaccucacucgaucucuaccgaagcagacucuguugguacgacuacguggagguccgagacggguucuggcgcaaagcaccgcuccgcggccgcuucugcggcucuaaacuucccgaacccauugucagcaccgacucgagacucugggucgaguucaggaguuccagcaacuggguaggcaaaggauucuuugcagucuacgaagccauaugcggcggcgacgucaagaaagacuacggccacauccaguccccaaacuacccagacgacuaccgccccuccaaagucugcauauggaggauacaaguaucagaaggguuucacgucggacugacauuccaaaguuucgaaauagaacgucacgacucaugcgcguacgacuaccuggaaguacgcgacggccauuccgaaagcagcacacuaauaggccgguacuguggcuacgaaaagcccgacgacauaaaaucaacaucaagcagacuguggcuaaaguucgucucggacggaagcauaaacaaagcaggauucgcagugaacuucuuuaaggaagucgacgaauguucgcgcccaaacaggggaggcugcgaacaaagaugccuuaacacacuggggucauauaagugcagcugcgaccccggauacgagcuugcaccagacaagcgaagaugugaggccgccugcggaggcuuccucacaaaacugaacggauccaucacaucacccggauggccaaaagaguaucccccgaauaaaaacugcauauggcagcuaguagcgccaacccaauaccggaucagccuccaguucgacuucuucgaaaccgaaggcaacgacgugugcaaauacgacuucgucgagguacgcagcggucuuaccgcggacucaaaacugcacggcaaauucugcggcagcgaaaaaccagaaguaaucaccagccaauacaacaacaugagagucgaauuuaaaucagacaacaccguauccaagaaaggcuucaaagcccacuucuuuuccgauaaagacgaaugcaguaaagauaacgggggcugucagcaagacugcguuaacacauucggaagcuacgaaugucaaugccgcaguggguucgugcugcacgacaacaaacacgacugcaaagaagcaggaugcgaccauaaagucaccagcacaagcggaacgaucacuagccccaacuggccggacaaauacccauccaagaaagaaugcacaugggccaucuccagcacccccggccaccgcgucaaauuaacauucauggagauggacaucgaaucacaacccgaaugcgccuacgaccaccuggagguauucgacggccgagacgccaaagcaccagugcucggccgcuucugcggcuccaagaaaccagaaccagugcuagccaccggcagucgaauguuccuccgcuucuacagugacaacaguguacaacgaaaaggauuccaagcaagccacgcaacagaaugcgguggccaaguccgggccgacgucaaaacaaaagaccuauacucacaugcucaauucggugacaacaacuacccgggcgguguagacugcgaaugggucaucgucgcagaagagggauacggggucgaacucguguuccaaacauucgaagucgaggaagagacagauuguggcuacgacuacauggaacucuucgacggguacgacagcaccgcccccagacuaggccgcuacuguggaucagguccacccgaagaagucuacagcgccggugacucaguacucgugaaauuccacagcgacgacacaauuacaaagaaaggcuuccaccuaagauacacguccaccaaauuccaggacacccuccacagccgcaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7181 - RNA, 1467 nt, Artificial Sequence
  mRNA product Design5 comprising derived and/or modified sequence from Homo sapiens__NP_001191.1__HsBMP2 (opt11)
gggagagucccgcagucggcguccagcggcucugcuuguucgugugugugucguugcaggccuuauucaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauucgaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauucaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7182 - RNA, 1503 nt, Artificial Sequence
  mRNA product Design5 comprising derived and/or modified sequence from Homo sapiens__NP_001193.2__HsBMP4 (opt11)
gggagagucccgcagucggcguccagcggcucugcuuguucgugugugugucguugcaggccuuauucaagcuuaccaugauaccgggcaaccgcaugcucauggucguucuccugugccaaguccuacucggcggcgcaagccacgccucacucauccccgaaacugggaaaaaaaaagucgccgaaauccaaggccacgccggcggaagacgcuccggccaaucacacgaacuccuccgcgacuucgaagccacccuacuacaaauguucggccuccgccgccgcccacaacccucaaagagcgccgucauccccgacuacaugcgcgaccuauaccgacuccaauccggcgaagaagaagaagaacaaauccacuccaccggacucgaauaccccgaacgccccgccucccgagcaaacaccguacguucuuuccaccacgaagaacaccucgaaaauauccccggcaccuccgaaaacuccgcauuccgcuuccuauucaaccucuccuccauccccgaaaacgaaguaaucucauccgcagaacuccgccuauuccgcgaacaagucgaccaaggccccgacugggaaagaggcuuccaccgaauaaacauuuacgaagucaugaaacccccagccgaagucguacccggccaccucaucacacgacuucucgacacacgccuaguccaccauaacguaacucgcugggaaaccuucgacguaagccccgccguccuccgauggacccgugaaaaacagcccaacuacggccucgcaauugaagucacccaccuccaccaaacacgcacacaccaaggccaacauguccgcauaucccgaucacucccacaaggcuccggcaacugggcccaacuccguccacuccucguuaccuucggccaugacggacgcggucacgcccucaccagacgccgcagggccaaacgaucccccaaacaucacucccagcgcgcucguaaaaaaaacaaaaacugccgccgccauucccuauacguagacuucuccgacgucggcuggaacgacuggauagucgcaccccccggauaccaagccuucuacugccacggcgacugccccuucccacucgcagaccaccuaaacucaaccaaucacgccaucguacaaacccucguaaacucagucaacuccuccauucccaaagccugcugcguacccaccgaacuauccgccaucuccaugcucuaccuagacgaauacgacaaagucguccucaaaaacuaccaagaaauggucgucgaaggcugcggcugccgauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7183 - RNA, 1818 nt, Artificial Sequence
  mRNA product Design5 comprising derived and/or modified sequence from Homo sapiens__NP_001709.1__HsBMP6 (opt11)
gggagagucccgcagucggcguccagcggcucugcuuguucgugugugugucguugcaggccuuauucaagcuuaccaugcccgggcuaggccgacgagcacaauggcuaugcuggugguggggccuacuaugcucaugcugcggaccaccuccccuacgcccaccccugcccgcagccgcugccgcagcugccggcggccaacuacuaggcgacggcggcucacccggccgaacagaacaacccccucccucuccccaauccucauccggauuccuauaccgcagacucaaaacccaagaaaaacgcgaaaugcaaaaagaaauccuaucaguacucggccugccacauagacccagaccccuccacggacuccaacaaccccaaccucccgcccugcgucaacaagaagaacaacaacaacaacagcaacuaccccgcggcgaacccccacccggccgccuaaaaucagcaccccuauuuaugcucgaccuuuacaacgcccucucugccgacaaugaugaagacggcgccuccgaaggugaacgccaacaauccuggccccacgaagccgccucaucaucacaacgacgacaacccccacccggcgccgcccacccacucaaccgaaaaucccuucucgcccccggaucugguuccgggggcgcuuccccacucaccuccgcacaagacagcgccuuccuaaacgacgccgacaugguuaugucauucguaaaccuagucgaauacgacaaagaauuuucacccagacaaagacaccauaaagaguucaaauucaaccucucccaaaucccagaaggcgaagucguaacagccgccgaguuccgaaucuacaaagacugcgucaugggauccuucaaaaaccaaaccuuccuaauaagcaucuaccaaguacuacaagaacaccaacaccgugacuccgaccucuuucuucuagacacccgaguagucugggccucagaagaagguuggcuugaguucgacaucaccgccaccagcaaccuauggguagucacaccccaacacaacaugggacugcaacuaucagucguaacccgcgacggcguacacguucacccccgagcagccggacucguaggucgcgacggacccuacgacaaacaacccuucauggucgccuucuuuaaagucuccgaaguacacguccgaacaacacgauccgcaucaucccgccgccgccagcaaucccggaaccgaucaacacaaucccaagacgucgcccgcgucagcucggcuucggacuacaacuccagcgaacuaaaaacagcaugccgcaaacacgaacuauacgucuccuuucaagaccucggauggcaagacuggaucaucgcacccaaaggauacgcagcaaacuacugcgacggagaaugcuccuucccccuaaaugcacacaugaacgcaaccaaccacgccaucguccaaacccucguccaccuaaugaaccccgaauauguacccaaacccugcugcgccccaaccaaacuaaacgcaaucucaguacucuacuucgacgacaacuccaacguaauccucaagaaauaccgcaacaugguuguccgugccugcggaugccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7184 - RNA, 1572 nt, Artificial Sequence
  mRNA product Design5 comprising derived and/or modified sequence from Homo sapiens__NP_001710.1__HsBMP7 (opt11)
gggagagucccgcagucggcguccagcggcucugcuuguucgugugugugucguugcaggccuuauucaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauucuuccacccccgcuaucaccaccgcgaauuccgauucgaccucucgaaaauacccgaaggcgaagccgugaccgcagccgaauuccgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7185 - RNA, 576 nt, Artificial Sequence
  mRNA product Design5 comprising derived and/or modified sequence from Homo sapiens__NP_006264.2__HsCCL7 (opt11)
gggagagucccgcagucggcguccagcggcucugcuuguucgugugugugucguugcaggccuuauucaagcuuaccaugaaagccuccgccgcccuccucugccuccuccucaccgccgccgccuucuccccccaaggccuagcccaacccgucggcaucaacaccuccaccaccugcugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7186 - RNA, 3900 nt, Artificial Sequence
  mRNA product Design5 comprising derived and/or modified sequence from Homo sapiens__NP_001954.2__HsEGF (opt11)
gggagagucccgcagucggcguccagcggcucugcuuguucgugugugugucguugcaggccuuauucaagcuuaccaugcugcucacgcugaucaucuuauuaccggucgucaguaaauuuagcuuuguaucacugagcgcaccccaacacuggucaugcccagagggcacuuuggcagggaacggcaauucgacgugcguaggaccagccccauuccugaucuucagccacggaaauagcaucuuccgaaucgacacagaaggaacgaacuaugagcaacucguagucgacgcagggguaucgguuaucauggacuuccauuacaacgagaaaagaauauacugggucgaccuagaacgacagcuccugcaaaggguauuccugaacggcucgcggcaggaacggguaugcaacauagagaaaaacgucagcggcauggccauaaacuggaucaacgaagaagugaucugguccaaccaacaggaaggcaucauaaccgucacugacaugaaaggaaacaacagccacauccuccuaucagcgcuaaaguaccccgccaaugucgcggucgacccaguagaacgguucauuuucugguccuccgaaguagcugggagccuuuaccgcgcagaccuagacggcgucggaguaaaagcacuacuugaaacauccgagaaaauaacagcaguaucccuugacguccuagacaagcgccucuucuggauacaauacaaucgcgaagggucuaacagccucaucugcaguugugacuaugacggcgggagcguacacaucucaaaacacccaacacaacauaaucuauucgcgaugagccucuucggugacagaauauucuacucaaccuggaagaugaaaacaauauggauagccaacaaacacacaggcaaagacaugguccgcaucaaccuccacagcuccuucguaccccucggcgaacuaaaaguagugcacccccuagcccagcccaaagccgaagaugauacgugggaacccgaacaaaagcugugcaaacugcgcaaagggaacugcagcaguaccguuugcggucaagacuuacagucucaccucugcaugugcgcugagggguacgcccuuucgagagacagaaaauacugcgaggacgucaacgaaugcgccuuuuggaaccacggcugcacacuuggcugcaaaaauacaccgggaagcuacuacugcacaugucccguaggauucguccuucuacccgauggaaagcgcugccaccaacuggucucguguccucgcaacgucucggaaugcagccaugacugcguacuaaccuccgaagguccacuaugcuucugcccagaggguucaguucuagagcgggacggcaagacaugcaguggaugcucauccccagacaacggcggaugcucccaacuaugcgucccacugagcccggucucaugggaaugcgacugcuucccuggguacgaccuccagcuugaugaaaaaucaugcgcugccuccgggccccagcccuuccuacucuucgccaacucgcaagacauaagacauaugcacuucgacggcacagauuacgggacccugcugucccaacagaugggcaugguauacgcacucgaccacgacccaguggaaaauaaaaucuauuucgcccacacagcccuuaaguggaucgaacgcgccaacauggacggcagccaaagagaacggcucauagaagaggggguggacgugccagagggccucgcugucgacuggauagggcgccgguucuacuggacagaccggggcaaaagccucauaggcagaucagaccucaacgggaaaaggagcaagaucauaacgaaagagaauaucucgcaaccccgcggaaucgccguccacccaauggcaaaaagacuauucuggacagauacgggaauaaacccccggaucgagagcuccucccuacaagggcucgggcgguuaguaaucgccuccagcgaccuaauauggcccagcgggauuaccaucgacuuccuaacagacaaacucuacuggugcgacgcaaaacaauccgucaucgaaauggccaaucuagacgguagcaaacgacgccgacucacacaaaacgacguaggccaucccuuugcggucgccgucuucgaggacuacgucugguucucugauugggccaugcccucagucaugcgagucaacaagcgcacgggaaaggaucgagugaggcuccagggcucgauguugaaaccaagcagccuaguagucguccacccacuggcaaaaccaggcgcagacccaugccuauaccagaacgggggcugugagcacaucuguaaaaagagacuaggaaccgcauggugcucaugcagggaaggguucaugaaagcguccgacggcaaaaccugccuugccuuagacggacaccaacuccuagcaggaggcgaaguugaccuuaaaaaccaaguaacgccguuagauauccucagcaaaacaaggguaagcgaggauaacaucaccgagucacagcacaugcucguggcagaaauuauggugucagaccaagacgacugcgcacccguaggcugcucuauguacgcaagaugcauauccgaaggcgaagacgccacaugccagugccugaagggcuuugccggggacgguaaacugugcuccgacauagaugagugcgaaaugggaguacccgucuguccgcccgcaagcuccaaaugcauaaacacagaaggcggauacgugugccggugcucagaaggauaccaaggcgacggaauccacugccuggacaucgacgaaugccaguuaggugaacauucgugcggggaaaacgccuccugcacuaacaccgaaggaggcuacacaugcaugugcgccggacgucugagcgaacccgggcuaauaugccccgacuccacaccacccccacacuugcgcgaggacgaccaccauuacagcguacggaacagcgacagcgaaugcccccuaucacacgacggcuacugcuuacacgacggcgucugcauguacaucgaagcccuagacaaauacgcgugcaacugcgugguagguuacauaggugagcguugccaauaccgagaccuuaaauggugggaacuacgccacgccggacacggccaacagcagaaggucaucgucgucgcaguaugcgucguaguccucgucaugcuucuacuccuaucacuauggggcgcacacuacuacagaacucaaaaauuauuaagcaagaaccccaaaaauccguacgaggaauccagcagagauguccgcagccggagaccggcggacacggaggacggcauguccucgugcccgcaacccugguucgucgucaucaaagaacaccaagaccugaagaacggcggccaacccguagcaggagaagacggacaagccgccgacggaagcaugcaaccgaccucguggcgacaagaaccccagcuaugcggcaugggcacugagcagggcugcuggauuccaguaaguagugacaaagguagcugcccacaggucauggagcgauccuuccauaugccuucuuacggaacacaaacacuagaaggcgguguagaaaagccgcauucucuccuguccgcaaacccgcucuggcaacaacgagcacuagauccaccccaccaaauggaacucacccaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7187 - RNA, 786 nt, Artificial Sequence
  mRNA product Design5 comprising derived and/or modified sequence from Homo sapiens__NP_001423.1__HsEREG (opt11)
gggagagucccgcagucggcguccagcggcucugcuuguucgugugugugucguugcaggccuuauucaagcuuaccaugaccgccggccgccgcauggaaaugcucugcgccggccgcguccccgcacuccuccucugccucggcuuccaccuccuucaagccguccucuccaccaccgucauccccuccugcauccccggcgaauccuccgacaacugcaccgcccuaguccaaaccgaagacaacccacgcgucgcccaagucuccaucacaaaaugcuccuccgacaugaacggcuacugccuccacggccaaugcaucuaccucgucgacaugucccaaaacuacugccgcugcgaagucggcuacaccggcguccgcugcgaacacuucuuccucaccguccaccaaccccucuccaaagaauacgucgcccucaccgucauccucaucauccucuuccucaucaccgucgucggcuccaccuacuacuucugccgcugguacagaaaccgcaaauccaaagaacccaaaaaagaauacgaacgcgucaccuccggcgaccccgaacucccccaagucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7188 - RNA, 744 nt, Artificial Sequence
  mRNA product Design5 comprising derived and/or modified sequence from Homo sapiens__NP_000791.1__HsFGF1 (opt11)
gggagagucccgcagucggcguccagcggcucugcuuguucgugugugugucguugcaggccuuauucaagcuuaccauggccgaaggcgaaaucaccaccuucaccgcccucaccgaaaaauucaaccucccccccggcaacuacaaaaaacccaaacuccucuacugcuccaacggcggccacuuccuccgcauccuccccgacggcaccgucgacggcacccgcgaccgcucagaccaacacauccaacuccaacucuccgccgaauccgucggcgaaguauacauaaaauccaccgaaaccggccaauaccucgccauggacaccgacggccuccucuacggcucccaaacccccaacgaagaaugccucuuccucgaacgccucgaagaaaaccacuacaacaccuacaucuccaaaaaacacgccgaaaaaaacugguucguaggccucaaaaaaaacggcuccugcaaaagaggcccccgcacccacuacggccaaaaagccauccucuuccucccacuccccgucucaucagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7189 - RNA, 1143 nt, Artificial Sequence
  mRNA product Design5 comprising derived and/or modified sequence from Homo sapiens__NP_001997.5__HsFGF2 (opt11)
gggagagucccgcagucggcguccagcggcucugcuuguucgugugugugucguugcaggccuuauucaagcuuaccaugguggggguagggggaggggacguggaggacguaacgccgaggccgggagggugucagauaagcgggagaggggcgagagggugcaacggaauaccgggagcggcggcgugggaggcggcgcugccgaggaggaggccgaggaggcacccgagcguaaacccaagaagcagagcagcagggagcccgaggacgagggggagaaggacggaggagaggccgagugggagcaggcugggggaucgggggagggggagagcacugccgggagggcgacuagggggaagagggagggggagggcgccggagagggugggagggagggggagggggagggggacggcggcgccgagagcggcgccggcggcgagggggagcaggccgggaccggcggggacgauggcagcggggagcauaaccacguugccggcgcugccggaagauggagggaguggggcguucccaccggggcacuucaaggauccgaagagacuguauuguaagaauggaggguucuuucuaaggauacauccggaugggagaguggauggggugagggaaaagagugacccgcacauaaagcugcaguugcaggcggaggagagagggguaguaagcauaaagggggugugcgcaaauagguaucuggcgaugaaggaggaugggaggcuauuggcgagcaagugugugacggacgagugcuuuuucuuugaaaggcuagagagcaauaacuacaacacguacaggagcagaaaguauacgagcugguauguggcgcugaagagaacgggacaguacaaguuagggagcaagacagggccagggcagaaggcaauauuguuccugccaaugagugcaaagagcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7190 - RNA, 861 nt, Artificial Sequence
  mRNA product Design5 comprising derived and/or modified sequence from Homo sapiens__NP_002000.1__HsFGF7 (opt11)
gggagagucccgcagucggcguccagcggcucugcuuguucgugugugugucguugcaggccuuauucaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauucuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7191 - RNA, 903 nt, Artificial Sequence
  mRNA product Design5 comprising derived and/or modified sequence from Homo sapiens__NP_001936.1__HsHBEGF (opt11)
gggagagucccgcagucggcguccagcggcucugcuuguucgugugugugucguugcaggccuuauucaagcuuaccaugaaacuccuccccuccguaguccucaaacuauuccucgcagccguccuauccgcccucgucaccggcgaaucacucgaacgccuccgccgcggccucgccgcaggcacaagcaaccccgacccccccaccgucuccaccgaccaacuccucccccuaggcggcggccgagaccgcaaaguccgcgaccuccaagaagcagaccucgaccuccuccgcgucacccucuccuccaaaccccaagcccuagcaacccccaacaaagaagaacacggcaaacgaaaaaaaaaaggcaaaggacuaggcaaaaaacgcgaccccugccuccgcaaauacaaagacuucugcauccacggcgaaugcaaauacgucaaagaacuacgcgcccccuccugcauaugccaccccggcuaccacggcgaacgaugccacggccuaucccuccccguagaaaaccgacuauacaccuacgaccacaccaccauccucgccgucgucgccgucguccucucauccgucugccuacucguaaucguaggacuccucauguuccgcuaccaccgccgaggcggcuacgacgucgaaaacgaagaaaaagucaaacucggcaugaccaacucccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7192 - RNA, 2463 nt, Artificial Sequence
  mRNA product Design5 comprising derived and/or modified sequence from Homo sapiens__NP_000592.3__HsHGF (opt11)
gggagagucccgcagucggcguccagcggcucugcuuguucgugugugugucguugcaggccuuauucaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7193 - RNA, 2202 nt, Artificial Sequence
  mRNA product Design5 comprising derived and/or modified sequence from Homo sapiens__NP_005336.3 __HsHSPA1A (opt11)
gggagagucccgcagucggcguccagcggcucugcuuguucgugugugugucguugcaggccuuauucaagcuuaccauggcaaaagcagcagcaauaggcaucgaccuaggaaccaccuacucaugcgucggagucuuccagcacggcaaaguagaaauaaucgcuaacgaccaaggaaacagaaccacgcccucguacgucgccuucaccgacaccgaacgacugauaggggacgcagcaaagaaccaggucgcacucaacccacaaaauacagucuucgacgcaaaaagacucauaggcagaaaauucggcgaccccguagugcaaagcgacaugaaacacuggccauuccaagugauaaacgacggggacaaaccaaaaguccaagucucauacaaaggcgaaacaaaggcauucuacccagaagaaaucuccagcauggucuuaaccaaaaugaaagaaauagccgaagcauaccucgguuacccaguaacgaacgcagucauuacaguacccgcauacuucaacgacagccaacggcaagccacgaaagacgcgggagucauagcagggcucaacguauuaagaauaaucaacgaaccaacagcagcagccaucgcauacggccuggaucgcacaggcaagggcgaaagaaacguacugaucuuugaccuaggcgggggcacguucgacguaagcauccugaccauagacgacgggauuuucgaggucaaagcaacagcaggggacacacaccugggcggggaagacuucgacaacagacucgugaaccacuucguagaagaguucaaacgcaaacacaagaaagacaucucgcagaacaaaagagcagugagaagacuacggaccgcgugcgagcgcgcaaaacgcacccuaagcucaagcacgcaggcgagccuggaaauagacagccucuucgaaggaaucgacuucuacacaucuauaacaagagcgagauucgaagaacugugcuccgaccucuuccgcuccacgcuggagccagucgaaaaagcgcuccgggaugcgaaacuggacaaagcacaaauccaugaccucguacuggucggaggcucgacccgcauuccaaaagugcaaaaacuccuccaggacuucuucaacggacgagaccucaacaaaucaaucaaccccgacgaagcagucgcguacggggccgcuguccaagccgcaauccugaugggggacaaaagcgagaaugugcaagaccuccuccuccucgacguggccccacucucgcuuggacucgagaccgcgggaggcguaaugacagcacucauaaaaagaaauucaacaaucccaacaaagcagacacagaucuucacaacguauagcgacaaucaaccgggcguacucauacaaguauacgagggcgaacgcgcaaugacgaaggacaacaaccuucuaggcagauucgagcucucaggcauaccaccagccccacgcgggguaccgcaaauagaagugacauucgacaucgacgcaaacggaaucuuaaacguaacagcgaccgauaaaucaaccggaaaggcgaacaaaaucacaaucacaaacgacaaaggacgccuuucaaaagaagagaucgagagaaugguacaggaggcagaaaaguacaaagcagaggacgagguccaacgcgaaagaguauccgccaaaaacgcccuggaaucauacgcauucaacaugaaguccgccgucgaagacgaaggucuaaagggaaagauauccgaagccgacaaaaagaaaguacuagauaaaugccaagaagucaucagcuggcucgacgcaaacaccuuggccgaaaaagacgaauuugaacacaaaagaaaagaacuugaacaaguaugcaaucccauaaucucaggccuguaccaaggcgcaggcgggccagggcccgggggcuuuggggcacaaggccccaaaggaggaagcggaagcgggccgacaauagaggaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7194 - RNA, 2202 nt, Artificial Sequence
  mRNA product Design5 comprising derived and/or modified sequence from Homo sapiens__NP_005337.2 __HsHSPA1B (opt11)
gggagagucccgcagucggcguccagcggcucugcuuguucgugugugugucguugcaggccuuauucaagcuuaccauggcgaaagcagcagcaaucggaaucgaccucgguaccacauacagcugcguaggcguauuccaacacgggaaaguagaaaucauagcaaacgaccaagggaaccggacaacccccuccuacgucgccuucaccgacacagaacgacuuaucggcgacgcagccaaaaaccaggucgccuuaaacccccaaaacaccgucuucgacgcaaaaagacucaucggaagaaaauucggggaccccgugguacaaagcgacaugaaacacuggcccuuccaaguaaucaacgacggagauaagcccaagguccaaguaucguacaaaggcgagaccaaagccuucuacccagaagaaauaucaagcaugguguuaaccaagaugaaggaaaucgccgaagccuaccucggcuacccagugacaaacgccguaauaaccgugcccgcguacuucaaugacucccaacgccaagccacgaaagacgccggcgucauagccggacuaaacguacuacgcauaauaaaugaaccgacagcagccgccaucgcauacggacucgaccgcacaggcaaaggcgaaagaaacguauugauauucgacuuaggcggaggcaccuucgacgucucgauacuaaccauagacgacggaauauucgaggucaaggccaccgccggagacacacaccuaggcggcgaagacuucgauaaucgucuagugaaccacuucguagaagaguucaagcgcaaacacaagaaagacaucucccaaaacaaacgugcagugcgaaggcuaagaaccgcaugcgaacgcgcaaaaagaacccucagcuccagcacacaagcgagccuagaaauagacagucucuucgaaggcaucgauuucuacaccucgauaacuagagcgcgcuucgaagaauuaugcagcgacuuauuccgaucgacauuagaaccuguagaaaaagcgcuccgggacgcgaaacuagacaaagcccaaauccacgacuugguccugguagggggcucuacaaggauaccgaaagugcaaaagcuauuacaagacuucuucaacggacgcgaucucaauaaauccaucaaccccgacgaggcaguagcauacggcgccgcgguccaggcagcgauacucaugggagacaaaucagaaaacgugcaagaccuccugcuccuugacguagcaccacucucgcucggacuagaaacggcgggaggggucaugaccgcacucaucaagagaaacaguaccaucccaaccaaacaaacccaaaucuucaccacauacucagacaaccaaccgggagugcuaauccaaguauacgaaggcgaacgcgcgaugaccaaagacaauaaccugcuaggaagauucgaacuaucaggcauacccccggcuccacgaggcgucccccaaaucgaaguaaccuucgacauagacgccaacggaauccucaacgugacagcgaccgacaaaagcaccgggaaagcaaacaaaaucacaaucacaaacgacaaaggacgauuaagcaaagaagagaucgagcgaaugguccaagaagccgaaaaguacaaagccgaagacgagguccaacgcgaacgaguaagcgccaaaaacgcauuagaauccuacgcguucaauaugaaaagcgcaguagaagacgaaggacugaaagggaaaauaagcgaagcagacaaaaagaaaguacucgacaaaugccaagaaguaaucuccuggcuagacgcaaauacccucgccgaaaaagacgaguucgaacacaaaagaaaagaacuggaacaagugugcaacccaauuaucucaggacuauaccagggggcaggcgggccaggacccggaggauucggcgcgcaaggaccaaaaggaggcagcggaagcggaccaacaaucgaggaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7195 - RNA, 2202 nt, Artificial Sequence
  mRNA product Design5 comprising derived and/or modified sequence from Homo sapiens__NP_005518.3 __HsHSPA1L (opt11)
gggagagucccgcagucggcguccagcggcucugcuuguucgugugugugucguugcaggccuuauucaagcuuaccauggcgacagcaaagggcauagcaauaggcaucgaccucggcaccacauacuccugcguaggcgucuuccaacacggcaaaguagaaaucaucgcaaacgaccaaggaaacaggacaacacccucauacgucgcauuuaccgacaccgaaagacuuaucggagacgcggccaaaaaccaggucgcaaugaacccccaaaauaccgucuucgacgcaaagcgacucauaggacgcaaauucaaugaccccgugguacaggcagacaugaaacuauggccguuccaaguuauaaacgaaggcggaaagccgaaaguccucguauccuacaaaggcgaaaacaaagccuucuaccccgaggaaaucucgagcaugguccuaaccaaacucaaagaaacagccgaagcauuccucgggcacccagucaccaacgcggucauaaccguaccagcauacuucaacgacucgcaaagacaggcaaccaaagacgccggagucaucgcaggacugaacguccuccgaaucaucaacgaaccaaccgccgcagccaucgccuacggacuagacaaaggcgggcaaggcgaacggcacguacuuaucuucgaccucgggggcggaaccuucgacgucuccauccugaccaucgacgaugggauauucgaagucaaagccacggccggagacacacaccucggaggcgaagacuucgacaaccgccuaguaagucacuucgucgaagaguucaaacgaaaacacaaaaaggacaucagccagaacaaacgagcaguacgccgccucaggacagcaugcgaacgcgccaaaaggacacuaagcuccuccacgcaagcaaaccucgaaauagacagccuauacgaaggaauagacuucuacacaagcaucacaagggccagauucgaagaacucugcgcagaccuauuccggggcacacucgaaccagucgaaaaagcgcugcgagacgccaagauggacaaagccaaaauccaugacauaguccucgucggaggcuccacccgaauccccaaaguacaacgacuucuacaggauuacuucaacggaagagaucucaauaaaucaaucaaccccgacgaggcggucgcauacggcgccgccgugcaggccgcaauacucaugggggacaaaagcgagaaaguacaagaccuguuacuacuggauguggcaccccuaagccucgggcuggaaaccgccggaggggucaugaccgcccucaucaaacgaaacuccacgauccccacaaaacaaacccaaauauucaccaccuacuccgacaaccagccaggaguacuaauccaaguauacgaaggagaacgcgccaugacaaaagacaacaaccuacuaggccgguucgaucuaacaggcauaccaccggcgccccgagggguaccccaaaucgaaguaacauucgacaucgacgccaacggcauacugaacgugaccgcaacggacaaaucgaccgggaaagugaacaaaauaacaaucacaaacgacaagggccgcuuaagcaaggaagaaaucgagcgcaugguccuagacgcagaaaaauacaaagccgaagacgaaguacaacgagagaaaaucgccgcgaagaacgcgcuggaaagcuacgcauucaacaugaaaagcguaguaucagacgagggacuaaaaggcaaaauaagcgaaagcgacaaaaacaaaauacucgacaaaugcaacgaacuacuaagcuggcuagaagucaaucaacucgccgaaaaagaugaguucgaccacaaacgcaaggaacucgaacaaaugugcaacccaauaaucaccaaacuuuaccaaggaggcugcacaggcccagcaugcggaacaggcuacguaccaggccgaccugccaccggccccaccauagaagaaguagacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7196 - RNA, 2196 nt, Artificial Sequence
  mRNA product Design5 comprising derived and/or modified sequence from Homo sapiens__NP_068814.2 __HsHSPA2 (opt11)
gggagagucccgcagucggcguccagcggcucugcuuguucgugugugugucguugcaggccuuauucaagcuuaccaugagugcgcgcggacccgcaaucggaauagaccucggcaccaccuacucaugcgugggcguauuccagcacggaaaagucgaaauaaucgcaaacgaccaagggaacagaaccacaccauccuauguggccuuuacugacaccgaacgccuaaucggagacgcugccaagaaccagguagcaaugaaccccacaaacacaaucuucgacgcaaagaggcuaaucggacgcaaguucgaagacgcaacaguccaaagcgacaugaagcacuggcccuuccgcguaguauccgaaggaggcaaacccaagguccaagucgaauacaaaggcgagacaaagaccuuuuucccagaagagaucucaagcaugguacucaccaaaaugaaagaaauagcggaggcauaucuuggaggaaagguccacagcgcagugauaacaguccccgcauacuuuaacgacagccaaagacaagcaacaaaagacgcaggaaccauaacaggacuuaacguccuccgaauaaucaaugaaccaacagcagcagcaaucgcauacggccuagacaagaaaggcugcgccggaggcgagaaaaacguccuaauauucgaccuaggcgggggaacguucgacgucucaauacucaccauagaagacggcaucuucgaggucaaaagcacggccggagacacacaccucggcggggaagacuucgacaaccgcauggugagccaucucgccgaagaguucaaaagaaagcacaagaaagauauaggccccaacaaacgggcagugagaaggcucaggaccgcaugcgaacgggcgaaaagaacccucagcucaagcacacaagcaaguauugaaaucgacucccuauacgaagggguagacuucuacaccucaaucacacgggcccgcuuugaggaacuaaacgccgaucuguuccgcggaacacuagaaccagucgaaaaagcacuccgagacgcaaaauuagacaaaggccaaauucaagaaauaguccuggucggagguuccacccgcaucccaaaaauccaaaaacuacuacaagacuucuucaacgggaaagaacucaacaaaucaauuaaccccgaugaagcagucgccuacggagcagcaguacaagcagcgauacucaucggggacaaaagcgagaacguccaagaccuacuacugcuagacgugaccccacucucacucgggauagagacagcaggcggaguaaugaccccacugauaaaacgaaacacaaccauacccacaaaacagacccagaccuucacaaccuacagcgacaaccagucauccguacucguccagguguacgagggagaacgagcaaugacgaaagacaacaaccuauugggcaaguucgaccuaacgggcauaccgcccgcgccccgcgguguaccacaaaucgaagucacuuuugacauagacgccaacggaauccuaaacgugaccgcggccgacaaaagcacagggaaggaaaacaagaucacaauaacaaacgacaaagggagacugagcaaagacgacauugaccgaaugguccaagaagcagaacgcuacaaaucugaagaugaggcaaacagagaccgagucgcugcaaagaacgcacuggaaucuuacaccuacaacaucaagcagaccgucgaagacgaaaaacugcgaggaaaaauaagcgaacaagacaaaaacaaaauacuggacaaaugucaagaagucauaaacuggcucgaccgaaaccaaauggccgaaaaagacgaauacgaacacaaacaaaaagaacucgaacgaguaugcaaccccauaaucucaaaauuauaccaaggaggcccaggaggcgggagcggcggaggaggcuccggagcgagcggaggccccaccaucgaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7197 - RNA, 2799 nt, Artificial Sequence
  mRNA product Design5 comprising derived and/or modified sequence from Homo sapiens__NP_002145.3 __HsHSPA4 (opt11)
gggagagucccgcagucggcguccagcggcucugcuuguucgugugugugucguugcaggccuuauucaagcuuaccaugucggucguaggaaucgaucugggcuuucaaucaugcuacguugcaguggcgagagcaggaggaaucgaaaccauagccaacgaauacagcgauagguguacgccggcaugcaucagcuucggccccaaaaacagaucaauaggagcagccgccaaaucacaagucaucuccaacgcaaagaacaccguacaaggcuucaagcgauuccauggcagagccuuuucggacccguucgucgaagcugaaaaauccaacuuagcguacgacauaguucaacucccaacaggauuaaccggcaucaaagucaccuacauggaagaggagcgaaacuuuaccaccgaacagguaaccgcgaugcuccuaagcaagcuaaaggaaaccgcagaaagcguccucaaaaagcccgucguagauugcguggucuccgucccaugcuucuacacggacgcagaacgucgcagcguaauggacgccacacaaauagccggacucaacugccuacggcugaugaacgaaacgaccgcagucgcacuggccuacgggauauauaagcaagaccuaccagcgcuggaagaaaaaccacguaacguggucuucgucgacaugggacacuccgccuaccaagucuccgugugcgcguucaaccgcggcaaacucaaaguccucgcaacagcguucgauaccacauugggcggacgcaaguucgaugaaguacucguaaaccacuucugcgaggaguucggcaaaaaguacaaacucgacaucaaaucgaaaauacgagcacuacuccgccuuagccaagaaugugaaaaacuaaagaaacugaugucagcaaacgccagcgaccuaccacuaucaauagaaugcuucaugaacgacguagacguaagcggaacgaugaaucgcggaaaauuccuggaaaugugcaacgaccuccucgcccgaguugagccgccacuacggagcgugcucgaacaaaccaagcucaagaaagaagacauauacgccguagaaauagucgggggcgcaacccgcauccccgccgugaaagagaaaaucucaaaauucuucgggaaagaacucagcaccacacucaacgccgacgaagcggugacccgaggcugcgcgcuccaaugcgcaauccuaagccccgccuucaaaguacgagaguucuccauaaccgacguaguccccuaucccauaucccuuagguggaauagccccgcagaagaaggcagcagcgacugcgaaguauucagcaaaaaccacgccgcacccuucucaaaaguacugaccuucuaccgaaaagaaccauucacacucgaggcauacuacagcuccccacaggaccucccauacccagacccggccaucgcccaauucagcguacaaaaagucacaccacaaagcgacgguagcucgagcaaagucaagguaaaaguccgggucaacguucacggcauauucucaguaagcagcgcaagccucguagaaguacacaaauccgaggaaaacgaagaacccauggaaaccgaccaaaacgccaaagaagaagagaaaaugcaaguagaucaagaggaaccacacgucgaggaacaacagcaacagacccccgccgaaaacaaagcagaaagcgaagaaauggaaaccagccaagccggcuccaaagauaagaaaauggaccaaccaccacaagccaaaaaggccaaagucaaaacauccacagucgaucuccccauagaaaaccaacuacuauggcaaaucgaccgcgagaugcucaacuuauacauagagaaugaaggcaaaaugauaaugcaagacaaacucgaaaaagagagaaacgacgccaaaaacgcagucgaagaauacgucuacgaaaugcgagacaaacuaagcggcgaauacgagaaauucguaucggaagacgacagaaacagcuucacccuaaagcuggaggacaccgaaaacuggcuauacgaagacggagaagaccaacccaaacaaguauacguagacaaacucgcagaacucaaaaaccuaggccaacccaucaaaauacgauuccaagaauccgaggaacgccccaaauuauucgaagaacucggcaagcaaauccaacaguacaugaaaauaauaucgagcuucaaaaacaaagaagaccaauacgaucaccuggacgcagcagacaugacuaaaguagaaaaaucaacaaacgaagcaauggaauggaugaacaacaaacucaaccuucaaaacaagcaaagccuuaccauggacccaguagucaaaagcaaggaaaucgaagccaagaucaaagagcucacaucaaccuguuccccuaucauaucaaaacccaaaccaaaaguagaaccacccaaggaagaacagaaaaacgccgaacaaaacggccccgucgacggacaaggcgacaaccccggcccccaagccgccgaacaagggaccgacaccgcaguaccaagcgacagcgauaagaaacuucccgaaauggacaucgacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7198 - RNA, 2796 nt, Artificial Sequence
  mRNA product Design5 comprising derived and/or modified sequence from Homo sapiens__NP_055093.2 __HsHSPA4L (opt11)
gggagagucccgcagucggcguccagcggcucugcuuguucgugugugugucguugcaggccuuauucaagcuuaccaugucagucgucggcaucgaucucggguuccugaacugcuacauagcagucgcccggaguggagggaucgagacaauagcaaacgaauacucggaccgcugcacacccgcaugcauaagccucggcuccagaacgagagccaucgguaacgccgcuaagagccaaaucguaaccaacguacgcaacacaauccacggcuuuaagaaacuccacggcagaucguuugacgacccuauaguccagacagagcgcauacgacugcccuacgaacuacagaaaaugccaaacgggagcgcgggcgucaaaguccgauaccuagaagaggagcgcccauucgcaauugaacaaguaacuggaaugcugcuagcaaaauuaaaagaaacgagcgaaaacgcccuaaagaaacccguagccgauugcguuaucucaauaccgagcuuuuucacagacgcagagcggcgcucagucauggccgcagcccaagucgccggccucaacugccuccgccucaugaacgaaacaacugccguugcccuggccuacggcaucuacaaacaagaccuaccgccccuggacgagaaaccgcgaaacgucgucuuuaucgacaugggacacuccgcauaccaaguucuaguaugcgccuucaacaaaggcaagcucaaaguacuggcaaccacauucgaccccuaccucgguggacgaaacuucgaugaagcgcucgucgacuacuucugcgacgaguucaaaacgaaauacaaaaucaacgucaaggagaacucccgggcccugcuaagacucuaccaagagugcgaaaaacuaaagaaacuuaugucggcaaacgccucagaccugccccucaacauagaauguuucaugaaugaccucgacguaagcuccaaaaugaaccgcgcacaauucgagcaacuaugcgccagccugcuagccaggguagaaccuccacuaaaagcagucauggagcaggcuaaccuacaacgcgaggacauaagcagcaucgagaucgugggaggcgccacacgcauacccgcagucaaagaacaaaucaccaaauuuuuccuaaaagacaucucaaccacccucaacgccgacgaagcaguagcgcgcggcugcgcccuccaaugcgcgauacucagcccagccuucaagguacgcgaguucaguaucaccgaccucguccccuacucaauaacacuaagauggaaaaccucguucgaagacggcuccggagaaugcgaaguauucugcaagaaucacccggcaccguucucgaagguaaucaccuuccacaagaaagaacccuucgaacuugaagcauucuacacaaaucuucacgagguaccauacccggacgcacgcauaggcucauucaccauccaaaacgucuucccccaauccgacggcgacucaagcaaagugaaagugaaaguccgcguaaauauccacggaauauucuccguagcaagcgcaucaguaaucgagaaacaaaaccucgaaggcgaccacagcgacgcaccaauggagaccgaaaccagcuucaagaacgagaacaaggacaauauggacaaaaugcaaguagaccaggaagaaggacaccagaaaugccacgcagaacacacccccgaggaagaaaucgaccacacaggcgccaaaacaaaauccgccguaagcgacaaacaggaucgccuaaaccagacgcucaaaaaggggaaagugaaauccauagaccuacccauccaguccucacuuugccgccagcuaggccaggaccuucugaacucauacaucgaaaacgaggggaaaaugaucaugcaagacaaacucgaaaaggaaaggaaugacgccaaaaacgcagucgaagaauacguauacgacuuccgcgaccgacugggcacaguauacgaaaaauucauuacacccgaagaccucaguaagcuaagcgcggucuuggaggacaccgagaacuggcucuacgaagacggcgaggaccagcccaaacaaguauacguggacaaacuacaagaacucaaaaaguacggacaaccuauccaaaugaaguacauggaacacgaagaacgcccaaaagcucuaaacgaccuaggcaagaagauacagcucguaaugaaggucaucgaagccuaccgcaacaaagacgaaagauacgaccaccuagacccaaccgaaauggaaaaaguagaaaaaugcauaagcgaugcaaugagcuggcucaacucuaagaugaaugcacaaaacaaacucucccuuacccaagacccagucguaaaagucucagaaauugucgcgaaaagcaaagagcuagacaacuucugcaaucccaucaucuacaagcccaaacccaaagcagaaguacccgaagacaaacccaaagccaacuccgaacacaacggcccgauggacggccaaagcggaaccgaaacaaaguccgacaguaccaaagacagcucgcagcacaccaaguccuccggcgaaauggaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7199 - RNA, 2241 nt, Artificial Sequence
  mRNA product Design5 comprising derived and/or modified sequence from Homo sapiens__NP_005338.1__HsHSPA5 (opt11)
gggagagucccgcagucggcguccagcggcucugcuuguucgugugugugucguugcaggccuuauucaagcuuaccaugaaacuaagccuggucgcagcaaugcugcuacuacuaagcgcagcaagggcagaggaagaagacaagaaagaggacgucggcacaguagucggaauagaccuggggacgaccuacagcuguguaggggucuucaagaacggcagaguugaaaucaucgcaaacgaccaaggcaaccgaauaacaccgagcuacguagcguucacacccgaaggcgaaagacucaucggggacgcagccaaaaaccaacuaacaagcaacccggaaaacacaguguucgacgccaaaagacuaaucggcagaaccuggaacgaccccuccguccaacaagacauaaaauuccucccauucaaagugguagaaaagaaaacgaaacccuacauacaagucgacauagggggcgggcagacaaaaacauucgcgccagaagaaaucagcgcaaugguccuaaccaaaaugaaagaaacggcagaagcguaccugggaaagaaagucacccacgccgucgucacgguccccgccuacuucaacgacgcgcaacgacaagcaaccaaagacgcaggcacgaucgcgggacugaacguaaugaggauaaucaacgaaccaacagcagccgccaucgcauacggacuggacaagcgcgaaggagagaaaaacauacuggucuucgaccugggcggaggaacauucgacgucucgcuacugacaauagacaacggcguauucgaggucguggcuacgaacggagacacacaccuaggaggggaagacuucgaccaacgagucauggaacacuucauaaaacuauacaagaagaaaaccggaaaagacguaagaaaagacaacagagccguacaaaaacugaggcgcgaaguagaaaaagcgaaacgggcccugagcucgcaacaccaagcgagaauagaaauagaguccuucuacgaaggagaagacuucagcgaaacacuaacgcgcgccaaauucgaagaacucaacauggaccucuuccgcucaacuaugaagcccguccaaaaagugcucgaagacagcgaccugaaaaagagcgauaucgacgaaauaguacugguaggcggaagcacacggaucccaaaaauacagcaacucgugaaagaguucuucaacggaaaagaaccaucgcgagggaucaacccagaugaagcggucgcauacggugcagcgguccaggccgggguacuaagcggagaccaagacacaggagaucugguacuccuugacgugugcccacuaacccucgggauagagaccguaggcggcguuaugacaaaacugaucccccgcaacaccguaguacccacgaagaaaagccaaaucuucagcacggcaagcgacaaccaaccgaccguaaccauaaaaguguaugagggggaacgaccccucacgaaagacaaccaccuacucggcacauucgaccucacaggaauaccaccagccccgcgcggaguaccacaaaucgaaguaacguucgaaaucgacgugaacggaauccuacgcgucaccgccgaggacaaagggaccggcaacaagaacaaaaucaccaucacgaacgaccaaaaccgccucacaccggaggaaaucgaacguauggucaacgacgcggaaaaguucgcggaagaggacaagaaacucaaagaacgcauagacacgcgaaacgaacuggaaucauacgcauacucacugaaaaaccaaauaggagacaaggaaaagcuaggaggcaagcuaucgagcgaggacaaagaaacaauggaaaaggcagucgaggagaaaauagaauggcuagaaucccaccaagacgcagacauagaagacuucaaagcgaaaaagaaagaguuagaagaaaucguucaaccaaucaucagcaaacuauacgguagcgcaggcccaccgccuacaggcgaggaagauaccgcagaaaaagacgagcuguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7200 - RNA, 2208 nt, Artificial Sequence
  mRNA product Design5 comprising derived and/or modified sequence from Homo sapiens__NP_002146.2__HsHSPA6 (opt11)
gggagagucccgcagucggcguccagcggcucugcuuguucgugugugugucguugcaggccuuauucaagcuuaccaugcaagccccacgagagcuagcaguaggaauagaccucggaacuacauacucaugcguaggcguauuccaacaaggacgcguagaaauacucgcaaacgaccaaggcaaccgcaccacgccaagcuacgucgccuuuaccgacaccgagagacucguaggcgacgcagccaaaucgcaggccgcccucaauccccacaacaccgucuucgacgcgaaaagacuaaucggccgaaaauucgccgauaccacaguccaaagcgacaugaaacacuggcccuuucgcguagugucagaaggaggaaaaccaaaagucagggucugcuaccgaggagaagacaaaaccuucuacccagaagagauaucgaguaugguacuauccaaaaugaaggaaaccgcagaagccuaccuaggacaaccaguaaagcacgccgucauaacaguaccagcguacuucaacgacagccaaagacaagccaccaaggacgccggggccauagccggacuaaacguccuccgcauaaucaacgaaccgaccgcugccgcgaucgcauacggccucgaccgcaggggagcuggcgaaagaaacguccucaucuucgaccucggagggggaacauucgacgucucaguacuaaguauagacgccggcguauuugaaguaaaagccacagcaggcgacacccaccuaggaggagaagacuucgacaaccgacucgugaaccacuucauggaagaguuccgacgcaaacacggcaaagaccucuccggcaacaaacgggccuugagacgacucagaacagccugcgaaagagcaaaaagaacacucagcucaagcacacaagcgacauuagaaauagacucccuauucgagggcguagacuucuauaccucgaucacacgcgcaagauucgaggaacugugcucagaccucuucagaucaacccucgaaccggucgagaaagcucuaagagacgccaaacuagacaaagcacaaauccacgacgucgucuuaguaggcggaagcacccgaauaccaaaagugcaaaaacuccuacaagacuucuucaacggaaaggagcucaacaagucaauaaaccccgacgaagccgucgcauacggggccgcaguacaggccgcagugcucaugggcgauaaaugcgagaaaguccaagaccuucuacuacucgacguagccccacuuucccuagggcucgaaaccgcgggcgggguaaugaccacccucauccaacgaaacgcaacaauaccaacuaaacaaacccagaccuucacaacauacucagacaaucaaccgggaguauucauacaagucuacgaaggcgaacgagccaugacaaaagacaacaaccuucucggcagguuugaacucagcggcauacccccagccccacgcggcgucccacaaauagaagucaccuucgauauagacgccaacggcauacucagcguaacggcaaccgaccgcagcaccggaaaagcgaacaagauaaccaucacaaacgacaaagggcgccuaagcaaagaagaggucgagcgcaugguccaugaagcagaacaguauaaagcagaggacgaagcccaacgagacagaguagcagcgaaaaacagucucgaggcacacguguuccacgucaaaggcucacuacaagaagagagccuacgagacaaaauccccgaagaagacaggcggaaaaugcaagauaaaugccgcgaaguacucgcuuggcucgagcacaaccaacuggccgaaaaggaggaauacgaacaccaaaaacgagaacucgagcagauaugccgacccauauucucccgccucuacggcggccccggcguccccggaggaagcagcugcggcacgcaagccagacaaggagaccccucaaccggacccauaaucgaagaaguggacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7201 - RNA, 1380 nt, Artificial Sequence
  mRNA product Design5 comprising derived and/or modified sequence from Homo sapiens__P48741__HsHSPA7 (opt11)
gggagagucccgcagucggcguccagcggcucugcuuguucgugugugugucguugcaggccuuauucaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuccgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7202 - RNA, 2217 nt, Artificial Sequence
  mRNA product Design5 comprising derived and/or modified sequence from Homo sapiens__NP_006588.1 __HsHSPA8 (opt11)
gggagagucccgcagucggcguccagcggcucugcuuguucgugugugugucguugcaggccuuauucaagcuuaccaugucaaaaggacccgcagugggaaucgaccuaggcaccaccuacucaugcguaggcgucuuccaacacggaaaagucgagauaaucgccaacgaccaaggaaacaggacgacaccaucauauguagccuucaccgacaccgagcgccuaauaggagacgccgccaaaaaccaggucgcaaugaacccaacgaacaccguauucgacgccaaacgacuaaucggccgccgauucgacgaugcagucguccagagcgacaugaaacacuggcccuucaugguaguaaacgacgccggccgaccaaagguacaagucgaauacaaaggcgaaaccaaauccuucuaccccgaagagguguccagcaugguccucaccaaaaugaaagaaauagcagaagcguaccuggggaaaacagucaccaacgcaguagucaccguccccgcauacuucaacgacagccagagacaagcaacaaaagacgcaggcaccaucgccgggcuaaacguccuacgcauaaucaacgaacccacagcagcugcaaucgcauacggucucgacaagaaaguuggugccgaacgcaacguccuaaucuucgaccucgggggcggcaccuucgacguaucaauccucacaauagaagacggaauauucgaagucaaaagcaccgcaggcgacacccaccuaggcggcgaggacuucgacaacagaaugguaaaccacuucaucgcagaguucaaacggaaacacaagaaagacaucuccgaaaacaaacgcgcaguacgacgccuacggacagcaugcgaacgcgccaaacgcacccucuccuccuccacccaagcaagcauagaaaucgacagccuauacgaaggaauagauuucuacacauccaucacaagggcgcgcuucgaagaacuaaacgcagaccucuuccgagguacccucgacccagucgaaaaagcauuaagagacgcaaaacuagacaaaagccaaauccacgacauaguccuggugggcggaucaacccguaucccuaaaauccaaaaacuacuacaggacuucuucaacggaaaagaacuaaacaaguccaucaacccagacgaagcuguggcauacggcgcggccguacaagccgccauccuaagcggcgacaaaucggaaaacgugcaggaccugcuacuccuagacgucacaccccucucacuaggcauagaaaccgcgggcggcguaaugaccguccuaauaaaacgaaacacaaccauaccaaccaaacaaacgcaaaccuucacaacauacagcgacaaccaaccagggguacucauccaaguauacgaaggcgaacgcgcaaugaccaaagacaacaaccuccuaggcaaauucgaacuuacaggaaucccacccgcaccccgagggguaccccaaauagaaguaacauuugacauagacgccaacggcauccuaaaugucagcgccgucgacaaaagcaccggaaaagaaaacaaaauaacgauaaccaacgacaaaggccgacugagcaaagaagacaucgagcgaaugguacaagaagccgaaaaauacaaagcagaggaugaaaaacagcgcgacaaaguaucaagcaaaaacagucuggaaagcuacgccuucaacaugaaagcaacaguggaagacgaaaaacuccaaggcaagaucaaugacgaagacaagcagaaaauccucgacaaaugcaacgaaaucaucaacuggcucgacaagaaccaaacagcagaaaaggaagaguucgaacaccaacagaaagaacucgaaaaagucugcaaccccauaaucacaaaacuguaccaauccgcaggcggaaugcccggcggcaugcccggaggauucccaggcggcggggcaccacccaguggcggagccagcucaggaccgacaaucgaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7203 - RNA, 2316 nt, Artificial Sequence
  mRNA product Design5 comprising derived and/or modified sequence from Homo sapiens__NP_004125.3 __HsHSPA9 (opt11)
gggagagucccgcagucggcguccagcggcucugcuuguucgugugugugucguugcaggccuuauucaagcuuaccaugauaagcgccucaagagcagcagccgccagacugguaggagccgcagcaucaaggggcccgacagcagccagacaccaagacucauggaacggccuaagccaugaagcauuccgccucguaagccgacgcgacuacgcgagcgaagcaauaaaaggagccguggucggcauagaccuaggaaccacgaacucgugcguggccguaauggagggaaaacaagcaaaaguacucgaaaacgccgaaggggcaagaacaacgcccucaguaguagcguucacugcggacggcgaaaggcuaguaggcaugccagcaaaacgacaagcggugacaaacccaaacaacacguucuacgcaacaaaacgacucauaggacgacgauacgacgacccggaaguacaaaaagacaucaaaaacgucccguucaaaauagugcgcgccaguaacggagacgccugggucgaagcccacggcaaacucuacagcccaucccagaucggcgccuucguccuaaugaagaugaaagagaccgccgaaaacuaccucggacacacagcuaaaaacgcagucaucacugugccagcguauuucaacgacagccaaaggcaagccacgaaagacgccgggcaaauaaguggacuaaacguccuaagggucaucaacgaaccgacugcagcggcccuggcauacggccuagacaagagcgaagacaaaguaauagccguauacgaccuaggaggcgggacauucgacauaagcauccuagaaauacagaaaggaguauucgagguaaaaagcacgaauggggacacguuccuggguggcgaagacuucgaccaagcacugcuacgccacaucgugaaggaguucaaacgagaaacaggggucgaccucacaaaagacaacauggcgcuccaacgaguccgcgaagcagcggaaaaagcaaaaugcgaacuaagcagcagcguacaaaccgacauaaaccuacccuaccuaacaauggacaguagcgggccaaaacaucucaacaugaaauuaacaagagcucaauucgaaggcaucguaacggaccuaauacgacgaaccaucgccccgugccaaaaagccaugcaagacgcagaaguaagcaagagcgacauaggagaaguaauacugguaggcggcaugacaagaaugccgaaaguacaacaaaccguacaagaccuauucggacgagcaccaagcaaagccgucaacccggaugaagcaguggccauuggcgcagcaauccagggaggcgugcuagcgggcgauguaacagacguacuccuacuagacguaaccccgcuaagccuaggaauagaaacccuaggcggaguauucacaaagcugauaaacagaaacacaacaaucccaaccaagaaaagccaaguauucagcaccgcggcagacgggcaaacccaaguggagaucaaagucugucaaggagaacgagagauggccggcgauaacaaacugcucggccaauucacccugaucggcauaccacccgcgccgagaggaguaccccaaaucgaggucacguucgauaucgacgccaacggcauaguccauguaagcgccaaagacaaaggaaccggacgcgaacaacaaauagucauccaaucaagcggaggccuaagcaaagacgacaucgagaacauggucaaaaacgcggaaaaauacgcagaggaagaccgaagaaagaaagaaagagucgaagcaguaaacauggccgaaggaauaauacacgacaccgaaaccaaaauggaagaguucaaagaccaacuaccagcugacgaaugcaacaaacucaaagaagaaauaaguaaaaugcgagagcuacuagcgcgcaaagacagcgaaacgggagaaaauauacgccaggcagcgagcagccugcaacaagcuagccuaaaacuguucgaaauggccuacaagaaaauggcauccgaaagggaaggaagcggaagcagcggcaccggcgaacagaaagaagaccaaaaagaagagaaacaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7204 - RNA, 2304 nt, Artificial Sequence
  mRNA product Design5 comprising derived and/or modified sequence from Homo sapiens__NP_079291.2__HsHSPA12A (opt11)
gggagagucccgcagucggcguccagcggcucugcuuguucgugugugugucguugcaggccuuauucaagcuuaccauggcagauaaagaagcaggcggauccgacgggccacgagaaaccgccccaacauccgcauacagcucgccagcccgaucacuaggagacaccgguauaacgccccuuucccccucccacaucgucaacgacaccgacucaaacguauccgaacaacaauccuucuuaguugucguggccgucgacuucggaacaacaucauccggcuaugccuauucauucaccaaagaaccggagugcauccacgucaugcgucgcugggaaggaggagaccccgggguuucaaaccagaaaacccccaccaccauccuucucacccccgaacggaaauuccacuccuucggcuacgccgcccgggacuucuaccacgaucuagacccgaacgaagcaaagcaauggcucuaccuagaaaaauucaaaaugaaacuucacaccaccggcgaccucacaauggauacagaccuuacagccgcaaacggcaagaaagucaaagcgcucgaaaucuucgccuacgcacuccaauacuucaaagaacaagcccucaaagagcuauccgaccaagccggcucagaguucgaaaacucagacguccgcugggucauaacaguaccugcgauauggaaacaacccgccaaacaguuuaugagacaagcagccuaccaggcuggacuggcauccccugaaaacucagaacaacucauaaucgcgcuagaacccgaagcugcaagcauauacugccgaaaacuccgccuccaccagaugaucgaacugagcuccaaagcagccguaaacggauacagcggcuccgacacugucggcgcaggauucacccaagcuaaagaacacauccgacgaaaccgccagucacgcacuuuccuagucgaaaacgucauaggagaaaucuggagcgaacuagaagaaggagacaaauacgucguggucgauucaggcggcggcaccgucgaccuaacaguccaccaaaucaggcuaccagagggccaccucaaagagcuauacaaagcaaccggcggccccuacggaucccucgguguagacuaugaguucgagaaacugcucuacaaaauauuuggcgaggacuuuaucgagcaauucaaaaucaaacgccccgccgccugggucgacuugaugaucgccuucgaaagccgaaaacgcgccgccgcccccgacagaacaaacccacuaaacaucaccuuacccuucucguucaucgacuacuacaagaaauuucgcggccacuccgucgagcacgcccuacgaaaaagcaacgucgacuucgucaaauggucaucgcaaggaaugcuccguaugucccccgacgccaugaaugcccuauucaaacccacaauagacuccaucaucgaacaccuccgcgaccucuuucaaaagccagaaguaucaaccgucaaauuucucuuccuagucggcggcuucgcagaagcaccccuacuccaacaagccguucaagccgcuuucggcgaccaaugcagaaucauaaucccacaagacguaggacucaccauucucaaaggcgccguacuuuucggccucgacccagccgucauuaaagugcgaagauccccucugacauacggcgucggaguccuaaaccgcuacgucgaaggaaaacacccacccgaaaaacuucuagucaaagacggcacccgauggugcaccgacguauucgauaaauucauaucagcagaccaaagcgucgcccucggcgagcuagucaaaagauccuacacacccgccaaaccaagccaacucgucaucguuaucaacauauacuccagcgaacacgacaacguaucguucauaaccgaccccgggguaaagaaaugcggcacccuccgccucgaccuaacaggcaccucaggcaccgccgucccagcacgcagagaaauacaaacccucaugcaguucggugacaccgaaaucaaagccaccgccaucgacauagcaaccaguaaaucggucaaaguaggcauagacuuucuaaacuacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7205 - RNA, 2337 nt, Artificial Sequence
  mRNA product Design5 comprising derived and/or modified sequence from Homo sapiens__NP_443202.3 __HsHSPA12B (opt11)
gggagagucccgcagucggcguccagcggcucugcuuguucgugugugugucguugcaggccuuauucaagcuuaccaugcuagccgucccagaaaugggcuuacaaggacuuuacaucggaagcuccccagaacgaucacccguacccagcccacccggaucaccccgcacccaggaaucaugcggaaucgcgccccugacacccagccaaagcccaaaacccgaaguacgggccccgcaacaagccuccuucagcguagucguggccauagacuucggaacgaccagcaguggcuacgcauucucauucgcaagcgauccagaggccauacacaugaugcgaaaaugggaaggcggcgacccaggaguagcacaccagaaaaccccaacaugccuacuccuaacccccgaaggcgccuuccacucauucggcuacacugcaagagauuacuaccacgaccucgacccggaagaagcccgcgacuggcucuacuucgagaaauucaagaugaaaauccacagcgccacagaccuaacacugaaaacccaacucgaggcggugaacggcaagacaaugccagcacucgaaguauucgcacacgcccuccgauucuuccgcgaacacgcacuacaagaacuacgcgaacaaagccccagucugcccgagaaggacaccguccgguggguguuaaccguacccgcaaucuggaaacaaccagcaaaacaauucaugcgcgaagccgccuacuuagccggacuuguaagcagagagaacgcagaacaacuccucauagcccuggaacccgaagccgccuccguauacugccgaaaacuacgacuacaccaacuacuagaccugucgggccgcgcccccggcggcggccgccuaggcgaaagacgaagcauagacuccuccuuccgccaagcccgagaacaacuaagaagauccagacacucacgaaccuuccuaguagaauccggagucggagaacuaugggccgaaaugcaagccggcgaccgcuacguagucgccgacugcggagggggcacugucgaccuuaccguacaccaacuagaacaaccacauggcacccuaaaagaacuauacaaagccucgggaggucccuacggggcugucggcguagaccucgcauucgagcaacuccuaugccgcaucuucggagaagacuucaucgcaacauucaaacgccaaaggcccgccgcaugggucgaccucacuaucgccuucgaagcacgaaaacgaacagcaggaccccaucgcgcaggcgcccucaacaucucacuacccuuuuccuucauagacuuuuacagaaaacaaagagggcacaacguagagacagcacucagacgauccagcgugaacuucguaaaauggucaucccaagggaugcugcgaaugucaugcgaagcaaugaacgagcuauuccaaccaacaguaucaggcauaauccaacacaucgaagcacugcucgcccgaccagaaguacaaggcguaaagcuccucuuccuagucggcggauucgccgaaagcgcaguccuccaacaugccguccaagccgcccugggcgcacgcggacuacgagucgucguaccacacgacgucggacucacgauacucaaaggagccguacuauucggacaagccccaggaguaguccgcguccgccguucgccgcucaccuacggcgucggcguccucaacagauucguaccaggacgccaucccccagaaaaacugcugguccgcgacggccgcagaugguguacagacgucuucgaacgcuucguagcagccgagcaauccgucgcgcuaggagaggaaguccgccguucauacugucccgccagacccggccaacgaagaguacucaucaaccuauacugcugcgcagcagaagacgcacgcuucauaacugacccaggcguccggaaaugcggcgcccucucacuagaacucgaacccgccgacugcggacaggacaccgcaggagccccacccggacgacgcgaaauucgggccgccaugcaauucggcgacaccgaaaucaaggugacagccguggacgucagcacgaaccgcagcguuagagcaagcauagacuuccucucaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7206 - RNA, 1692 nt, Artificial Sequence
  mRNA product Design5 comprising derived and/or modified sequence from Homo sapiens__NP_008879.3__HsHSPA13 (opt11)
gggagagucccgcagucggcguccagcggcucugcuuguucgugugugugucguugcaggccuuauucaagcuuaccauggcccgcgaaaugaccauccucggcucagccguccuuacccuacuacuagcgggauaccuagcccaacaauaccuuccacuacccacccccaaagucauagguauagaccucggaaccaccuacugcuccgucggcgucuucuuucccggaaccggaaaagucaaagucaucccagacgaaaacggacacaucucuauccccucgauggucagcuucacagacaacgacguauacgucggcuacgaauccgucgagcuagccgacagcaacccacaaaacacaaucuacgacgccaaacgcuucaucggcaaaaucuucaccgccgaagaacucgaagccgaaaucggacgcuaccccuucaaaguacucaacaaaaacggcauggucgaguucucaguaaccagcaacgaaaccauaaccguaucccccgaauacgucggcucacgcuuacuacuaaaacucaaagagauggcagaggcuuaccucggcaugccggucgccaacgcugucauaagcguccccgcggaguucgaccucaaacaacgcaacuccaccauugaagcagcgaaccuggcaggacuaaaaauccuccggguaauaaacgaacccacagcagcagccauggccuacggacuccauaaagccgacgucuuucacguucuagucaucgacuuaggcggaggcacccucgacgucucccuccucaacaaacagggcggaauguuccuaacacgcgccaugucaggcaacaacaaacucggcggccaggacuucaaccaacgccuacuucaauaccucuacaaacagaucuaccagaccuauggauucguacccucucggaaagaagaaauccaccgccuccgccaagccguagaaaugguuaaacucaaccucacccuacaccagucagcgcaacuauccguccuccucacggucgaagaacaagaccgcaaagaaccccacucaucagacaccgaacuccccaaagacaaacucuccucagccgacgaccaccgcgugaacucaggcuucggccgcggccuauccgacaagaaauccggcgaaucucaaguacucuucgagacagaaauaagccgcaaacucuucgacacccuaaacgaagaccucuuccagaaaauacucguacccauccaacaaguccuaaaagaaggccaccuugagaaaaccgaaaucgacgaagucguucucgucggcggcuccacccgcaucccccguauucgacaagucauacaagaauuuuucggaaaagaucccaacacuagcgucgaccccgaccuugcaguagucacagggguagccauccaagccggaauagacggcggauccuggccccuucaagucuccgcacucgaaauccccaacaaacaccuucagaaaaccaacuucaacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7207 - RNA, 1806 nt, Artificial Sequence
  mRNA product Design5 comprising derived and/or modified sequence from Homo sapiens__NP_057383.2__HsHSPA14 (opt11)
gggagagucccgcagucggcguccagcggcucugcuuguucgugugugugucguugcaggccuuauucaagcuuaccauggccgccaucggaguccaccucggcugcacauccgccugcguggccgucuacaaagacggacgcgcaggcguagucgccaacgacgccggagaccgcgucacccccgccguagucgccuacagcgaaaacgaggaaauagucggacucgccgccaaacaaucccgaauacgcaacauauccaacacaguaaugaaagucaaacaaauccucggacgaagcagcagcgacccacaagcccaaaaauacaucgccgaauccaaaugccuugucaucgagaaaaacggaaaacuacgauacgaaaucgacacaggggaagaaaccaaguucgucaacccagaggacgucgcacgccucaucuucagcaaaaugaaggagaccgcacauagcguacuaggguccgacgccaacgacgucguaauaaccgucccauuugacuucggcgaaaaacaaaagaacgcacuaggcgaagccgcccgcgccgcuggcuucaacguccugcgacuaauacacgaaccaucagcagcacuacuagccuacggcaucggacaagacucaccaacaggcaaaucaaacauacucguauucaaacucggaggcacuagccuaucacuauccguaauggaggugaacagcggcaucuaccgcguacucaguaccaacacagaugacaacauaggcggcgcccacuucacagaaacccuagcgcaauaccuagcgucggaauuucaacgcagcuucaaacacgacgucagaggaaacgcccgcgcgaugaugaaacuaaccaacagcgcggaagucgcaaaacacucccucucaacccucggcuccgccaacugcuuccucgacucacucuacgaaggccaggacuucgacugcaacgucucaagagcccgcuucgaacuccugugcuccccacuauuuaacaaauguaucgaagcaauacgcggacuccuagaccaaaacggcuucacagccgacgacaucaacaaagucguccucugcggcggcagcucgcgcauccccaaacuccaacaacuaaucaaagaccucuucccagccgucgaacuacucaacucgaucccacccgaugaaguuauucccauuggagccgccaucgaagccggcauccuaaucggcaaagaaaaccuacugguagaagacucacuaaugaucgaaugcucagcccgcgacauccucgucaaaggagucgacgaaagcggagccucccgauucaccguacuauucccuuccggaacgccgcucccagcccgccgacaacacacccuccaagcccccggcuccaucuccuccgucugccucgaacucuacgaaagugauggcaaaaacucagccaaagaagaaaccaaauucgcgcaaguaguacuacaagaccucgacaagaaagaaaacggacuacgcgacauccuagccguacucaccaugaaacgcgacggaucacuccacguaaccugcacagaccaagaaacaggcaaaugcgaagcuaucuccauagaaaucgccucaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7208 - RNA, 2853 nt, Artificial Sequence
  mRNA product Design5 comprising derived and/or modified sequence from Homo sapiens__NP_006635.2 __HsHSPH1 (opt11)
gggagagucccgcagucggcguccagcggcucugcuuguucgugugugugucguugcaggccuuauucaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgccaaaaaccaacaaauaacccaugcaaacaacaccgucagcaacuucaaacgauuccacggacgugccuucaacgaccccuuuauacaaaaagaaaaagaaaaccuauccuacgaccuagucccccucaagaauggaggcgugggcaucaaaguuauguauaugggagaagaacaccuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgccugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaaguccuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgccuauaccaggaaugcgaaaagcuaaagaaacugauguccuccaacuccaccgaccuaccccuaaacaucgaauguuucaugaacgacaaggacgucagcggaaagaugaacagaucccaguucgaggagcucugcgccgagcuacuccaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccauccuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacagaaagauggcgagaaaagccgcguaaaggucaaaguccgagucaacacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuacuaaacauguacaucgaaaccgaaggcaaaaugauaaugcaagauaaacucgaaaaagaacgcaacgacgccaaaaacgcagucgaagaauacguauacgaguuccgggacaaacuaugcggcccauacgaaaaauucaucugugaacaagaccaccaaaacuuucuacgucuauuaaccgaaaccgaagacuggcucuacgaagaaggcgaagaccaagcaaaacaggcuuacgucgauaaacuggaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacugaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7209 - RNA, 3276 nt, Artificial Sequence
  mRNA product Design5 comprising derived and/or modified sequence from Homo sapiens__NP_006380.1 __HsHYOU1 (opt11)
gggagagucccgcagucggcguccagcggcucugcuuguucgugugugugucguugcaggccuuauucaagcuuaccauggcagacaaggucaggcggcaacgaccacggaggcgcguauguugggcgcuagucgcaguccuacuugcggaccuacuggcacuaagcgacacgcuggcaguuauguccguagaccucggaagcgaaucgaugaaagucgcgaucgucaaacccggcgucccaauggaaauaguccuaaacaaggaaagccgcaggaagaccccggugauagugacacucaaagagaacgaacgcuucuucggagacucggccgcgagcauggccauaaagaaccccaaagcaacgcuaagauacuuccaacaccuccucgggaaacaagcagacaacccacacguggcacucuaccaggcaagguucccagaacacgagcugacauucgacccgcaacgccaaacgguacacuuccaaauaucaucacaacugcaauuuucacccgaagaaguccuaggaauggugcucaacuacuccagaucauuagccgaagauuucgccgaacaaccaauaaaagacgcagucauaacaguacccgucuucuucaaccaggcagaacgccgagcaguccuacaagccgcgaggauggcaggccuuaaaguccuccaacugaucaacgacaacaccgcaacagcacugagcuauggcgucuucagacggaaggacauaaacaccaccgcacagaauauaauguuuuacgacaugggaagcggauccacagugugcaccauaguaaccuaccaaauggugaaaacgaaggaggccggcaugcaaccucagcuccaaauccgagggguaggauucgaccggacacucggcgggcuagaaauggaacuacggcuaagagaaagauuagcgggacuguucaacgaacagcgaaaaggacaacgagcgaaagacgucagggaaaacccccgcgcgauggcaaagcuccuucgagaggcaaaccgccugaaaacagugcugucagcgaacgcggaccacauggcucaaauagaaggacucauggacgacgucgacuucaaagcaaagguaacacgagucgaauuugaagaacuaugcgcggaucuauucgaaagagugcccggacccguacagcaagcacugcaguccgccgaaaugucccuagaugaaauagaacaaguuauccuagucggcggcgccaccagaguaccacgagugcaggaaguacuacucaaagccguaggcaaggaggaacuagggaaaaacauaaacgccgacgaagcagcagcgaugggggcaguuuaccaagccgccgcacucagcaaggcauucaaagucaaacccuucgucguacgagacgccgucguauacccgauacugguagaguucacacgcgaaguggaggaggaaccaggaauacauagccugaaacacaacaagcgaguucucuucagccgaaugggccccuacccccaaagaaaagugaucaccuucaaccgguacagccacgacuucaacuuccacauaaacuacggcgaccucggauucuuggggcccgaagaccucaggguauucgggagccaaaaccugacaacagucaaacucaaaggcguaggcgacagcuucaaaaaguacccagauuacgaaaguaaaggcauaaaagcacacuucaaucuugacgaaagcggagugcucucgcucgaccgcguggagagcgucuuugaaacccuaguagaggacagcgccgaagaagaaagcacgcuaacaaagcugggaaacaccauauccucacuauucggagggggaacgacaccagacgcaaaagagaacggaaccgacaccguccaagaagaggaagagagcccagcugaaggguccaaagacgagccaggagaacaaguugaacuuaaagaagaagcggaggccccuguugaggacggaagccaaccgcccccacccgaacccaaaggcgacgccacaccagaaggcgaaaaggcaaccgagaaggaaaacggagacaaauccgaagcccaaaaaccaagcgaaaaagcagaggccggcccagaaggggucgcgcccgcaccggaaggggagaagaagcaaaaacccgcacgaaaacgcagaaugguggaagaaaucggaguagagcuagucguacuagaccuaccagaucugccggaagacaaacuagcacaaucaguucagaaacuucaagacuugacccuacgggaccuggaaaaacaagaaagagaaaaagcagccaacagucucgaagccuucaucuucgagacacaagacaaacuguaccaacccgaguaccaggaaguaagcacagaagaacagagagaagaaaucaguggaaaacugagcgcugcgucaacauggcuagaagacgaagggguaggugcaacaaccgucaugcuuaaagaaaagcucgccgaacugcgcaaacucugccaagggcuauucuuccgaguagaagagaggaagaaauggccagaaaggcuauccgcacuagacaaccuacugaaccacucgagcauguuccuaaagggagcaagacucauaccagagauggaccaaauauucaccgagguggaaaugacaacacucgaaaagguaauaaacgaaacgugggccuggaaaaacgccacacuagcagagcaagccaaacugccagcaacagagaaaccaguacugcuaucaaaggacaucgaagcaaaaaugauggcacuggacagagaggugcaauaccuccucaacaaagcaaaauucacaaaacccagaccacgaccaaaagauaagaacggaacacgcgcagagccaccccuaaaugcuucggcgagcgaucaaggggagaaaguaauacccccagccgggcaaaccgaggacgccgagccgaucuccgaacccgaaaaggucgaaacaggcucagaacccggggauacagaaccacuugaacucggcggacccggagccgagccagaacagaaggaacaaaguacagggcaaaaacgcccccugaaaaacgacgaacuauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7210 - RNA, 2475 nt, Artificial Sequence
  mRNA product Design5 comprising derived and/or modified sequence from Homo sapiens__NP_005339.3 __HsHSP90AA1 (opt11)
gggagagucccgcagucggcguccagcggcucugcuuguucgugugugugucguugcaggccuuauucaagcuuaccaugccagaagaaacccaaacacaagaucaaccaauggaagaagaagaaguggaaaccuucgcguuccaggcggaaauagcccaacuaaugucccucaucaucaacaccuucuacagcaacaaggaaaucuuccugcgagaacuuaucagcaacagcagcgacgcccucgauaagaucagauacgaaagccuaacugacccaagcaaacuagauagcgggaaagaacuccacaucaaccuaauacccaacaaacaagaccggacccucacaauaguagacaccggaaucggaaugacaaaggcggaccuuauaaacaaucugggaaccaucgcgaaaagcgggacaaaggcauucauggaagcgcuccaggcaggggcagacauaucaaugaucggccaauucggagucggcuucuacucagcguaccuaguagccgagaaaguaaccgucauaaccaaacacaacgacgaugagcaguacgcgugggagagcagcgcgggaggaucguucacagugagaaccgacacaggggaaccgaugggacgcggaacgaaaguaauacuacaccucaaagaagaccagaccgaauaccucgaagaaaggcgaauaaaagaaauagugaagaaacacucccaguucaucggauacccgauaacacuauucguggagaaagagcgcgacaaagaggucagcgacgacgaagcagaagaaaaagaagacaaagaagaggaaaaggaaaaagaagaaaaagaaagcgaagacaaaccagagaucgaagacgugggaagcgacgaagaagaagaaaagaaagauggagacaagaagaaaaagaagaaaaucaaagagaaauacauagaccaagaagaacuaaacaaaacgaaaccaaucuggacccggaacccagacgacauaaccaaugaagaauacggcgaguucuacaaaucacucacaaacgacugggaagaccaccucgccguaaaacacuucucgguagagggacaacuagaguuccgagcgcuccuguucgugccaaggcgagccccauuugaccuguucgagaauagaaagaagaaaaacaacauaaaacucuacguccgccgggucuucaucauggacaacugugaagaacuaauuccggaauaccugaacuucauccgcggcguaguggacagcgaagaccugccgcucaacaucucgagagaaauguuacaacaaagcaaaauccucaaaguaauaaggaagaaccucgugaagaaaugccuggaauuauucacagaacuagccgaagacaaagaaaacuacaagaaauucuacgagcaauucagcaaaaacauaaaacugggcauccacgaagacagccaaaaccgcaagaaacuauccgagcuccuacgcuacuacaccuccgcauccggggaugagauggugucacuaaaagacuacugcaccagaaugaaagaaaaccaaaaacacaucuacuacaucacgggcgaaacaaaagaccaaguagcgaacucagccuucgucgagcgccuacgaaaacacgggcuagaagucauauacaugaucgaaccaauagacgaauacugcguccaacaacucaaagaguucgaaggaaaaacccucgucagcguuaccaaagaaggcuuggagcuccccgaagacgaagaagagaaaaagaaacaagaagaaaagaaaaccaaauucgaaaaccugugcaaaaucaugaaggacauacuggaaaagaaaguagagaaggucguaguaucaaacaggcucgugaccagccccugcugcauagucacaucuaccuacggauggacggccaacauggaaagaauaaugaaggcccaagcacuccgcgacaacucgacaaugggcuacauggcggccaagaaacaccucgagaucaaccccgaccacuccaucaucgaaacgcucaggcagaaagccgaagcagacaaaaacgauaaauccgugaaggaccucguaauacuccuauaugaaacggcccuucuaagcagcggguucagccucgaagacccgcaaacgcacgcgaacaggaucuaccgaaugaucaaacucggccuugggaucgacgaagacgacccaacagcagacgacacgagcgcggccguaacggaagaaaugccaccacuagaaggcgacgacgacacgagcaggauggaggaaguggacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7211 - RNA, 615 nt, Artificial Sequence
  mRNA product Design5 comprising derived and/or modified sequence from Homo sapiens__NG_005218__HsHSP90AA3P (opt11)
gggagagucccgcagucggcguccagcggcucugcuuguucgugugugugucguugcaggccuuauucaagcuuaccauggacagcucaaaacuggacucgggcaagggccugcacauaaaccuggucccgaacaagcaaaaccaaacacucacgaucguggacacgcgcauaggcaugaccaagaccgaccucauaaacaaccucgggaccgugaccaagagcgggaccaaggccuucauggaggcccugcaagcggacgcggacauaagcaugaucggacacuucggcgugggcuucuacucggccuaccucguggccaagaaagugaccgugaucucaaaacacaacaacgacgagcaauacaccugggaaucgagcgcgggcgggagcuucaccgugcgcacggacgaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7212 - RNA, 2451 nt, Artificial Sequence
  mRNA product Design5 comprising derived and/or modified sequence from Homo sapiens__NP_031381.2__HsHSP90AB1 (opt11)
gggagagucccgcagucggcguccagcggcucugcuuguucgugugugugucguugcaggccuuauucaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagagcgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagagcugaacaaaacaaaaccaaucuggaccaggaaccccgaugacaucacacaagaagaauacggggaauucuacaaaucgcuaacaaacgacugggaggaccaccucgcgguaaagcacuucagcguggaaggacaacucgaauucagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauucgacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuucgaaacagcccuacucucaagcggauuuucacuggaggacccacaaacccacagcaacagaaucuaccgaaugauuaagcucggacuggguauugacgaggacgaaguagccgcggaagagcccaacgcggcaguccccgacgaaaucccgccccuggaaggggacgaggacgcaucaagaauggaagaggucgacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7213 - RNA, 2688 nt, Artificial Sequence
  mRNA product Design5 comprising derived and/or modified sequence from Homo sapiens__NP_003290.1__HsHSP90B1 (opt11)
gggagagucccgcagucggcguccagcggcucugcuuguucgugugugugucguugcaggccuuauucaagcuuaccaugagagcccuaugggugcucgggcucugcugcguacuacucacguucggaucaguccgagcagacgacgaggucgacgucgacggaacggucgaagaagaccuaggaaaaagccgcgaaggcagccggacagacgacgaggucguccagcgagaggaagaggcaauacaacucgacggucuaaacgccagccagauacgcgagcuccgggagaaaagugaaaaauucgccuuccaagcagaggucaacagaaugaugaaacucauaauuaacucccuauacaaaaacaaagaaauauuccugcgggaacuaaucuccaacgccagcgacgccuuagacaaaauacgacucaucagccugacagacgaaaacgccuugagcgggaacgaggaacuaaccgugaaaauaaaaugcgacaaagagaagaaccugcuacacguaacggauacgggaguaggcaugacacgagaagaacucgucaaaaaccucggaaccauagccaagagcggcacaagcgaguuccucaacaaaaugacagaagcccaggaggacggccaaucaacgagugagcuuauaggccaauucgggguaggguucuacagcgcguuccuaguagcggacaaaguaauagucacaagcaaacacaauaacgauacacagcacauaugggaaucagacagcaacgaauuuagcgugaucgcggacccgcggggaaacacgcuuggcagaggaaccaccaucacucuaguacucaaggaagaggcuucagacuaucuagaacuggacacaaucaaaaaccucguaaagaaauacagccaauucauaaacuucccgauauacgucuggagcucgaaaacagaaacaguagaggagccgauggaggaggaagaggcagccaaagaagaaaaagaagaaucggacgacgaagcggcagucgaagaagaagaggaagagaaaaagcccaaaaccaagaaaguagagaaaaccguaugggacugggaacucaugaacgacauaaaacccauauggcagcgcccgagcaaagaagucgaggaagacgaauacaaagccuucuacaagagcuucagcaaagaaagcgacgacccgauggccuauauacacuucacagccgaaggagaggugacguucaaaagcauccucuucgucccgacgagcgcccccaggggacucuucgacgaauacgggaguaagaaaagcgacuacaucaaacuauacguccgacggguguucauaaccgacgacuuccacgacaugaugcccaaguaccugaacuucgucaaaggagugguagauucagaugaccugccacucaacguaagcagagagacgcuccaacagcacaaacugcucaagguaauacgcaagaagcuagucaggaaaacgcucgacaugaucaaaaagauugcggacgauaaguacaacgacacguucuggaaggaguucggaacgaacauaaaacuaggcguaaucgaagaccacagcaaccgaacaagacucgcaaaacuccucagauuccagagcagccaucaccccacagacauaacaagccuggaccaauauguggaacgaaugaaagaaaaacaggacaaaaucuacuucauggcgggauccagccgcaaagaggcagaaagcagccccuucguagaacgacuccuaaagaaaggcuacgaagucaucuacuugaccgaaccaguagacgaauacugcauccaggcccuucccgaguucgacggcaagagauuccaaaacgucgcgaaggaaggcguaaaauucgacgaaagcgagaagacgaaagaaucgagggaagcagucgagaaagaguucgaaccacugcucaacuggaugaaagacaaagcgcuaaaagacaagauagaaaaagcgguaguaucgcaacggcugaccgaaagcccaugcgcccuagucgcgagccaauacggcuggagcgggaacauggaaagaauuaugaaagcgcaagccuaccagacaggaaaggacaucagcaccaacuacuacgccagccaaaagaagacguucgaaaucaacccaagacacccgcuaauaagagacaugcuacgaaggaucaaggaagacgaggacgacaagaccgugcucgaccucgcggucgugcuauucgaaacggccacgcuuagaagcggauaccugcuacccgacacgaaagccuacggcgaccgaaucgaacgcaugcuaaggcucagucuaaacauagaccccgacgcgaaaguggaagaggaaccagaggaggaaccagaagaaacggcagaggacaccaccgaggacacagaacaggacgaggacgaggagauggacgucggaacggacgaagaggaagaaaccgcaaaggaaucgaccgcagaaaaggacgagcuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7214 - RNA, 2391 nt, Artificial Sequence
  mRNA product Design5 comprising derived and/or modified sequence from Homo sapiens__NP_057376.2__HsTRAP1 (opt11)
gggagagucccgcagucggcguccagcggcucugcuuguucgugugugugucguugcaggccuuauucaagcuuaccauggcccgcgaauuacgagcccuacuacuauggggucgccgacuccgcccacuacuccgagcccccgcacucgccgcagucccuggaggaaaacccauacucugcccccgaagaacaacagcucaacucggcccccgucgcaacccagccuggucgcuccaggccggccgacucuucuccacacaaaccgccgaagacaaagaagaaccccuccacagcauaaucagcagcaccgaguccguacaaggaagcaccuccaaacacgaguuccaggccgaaaccaagaaacuucucgacaucguagcccgaagucuauacuccgaaaaagaagucuucauccgagaacuuaucucuaacgcauccgacgcacucgaaaaacuacgacacaaacucguaucagacggucaagcacuacccgaaauggaaauacaucuacaaaccaacgcagaaaaagguaccauaacaauucaagacacgggaauaggaaugacgcaggaggaacucgucucaaaccuaggcacuauagcccgaagcggcagcaaagccuuccucgacgcccuccaaaaccaagccgaagccuccuccaaaaucaucggucaguucggcguaggcuucuauuccgccuucaugguagcagaccgagucgaaguauauucucgcucagcagcccccggcucccuaggcuaccaauggcuauccgacggcagcggcguguucgaaauagcagaagccucgggcguccguacaggcaccaaaaucaucauacaccuaaaaagcgacugcaaagaauuuagcucagaagcccgcguccgagacgucgucaccaaauauucaaauuucgucucauuuccacucuaucuaaacggcagacgcaugaacacgcuccaagccaucuggaugauggacccaaaagacguccgcgaauggcagcaugaagaguucuaccgcuacguagcacaagcgcacgacaaaccacgcuacacccuccacuacaaaacggacgccccacuaaacauccgcuccaucuucuacguaccggacaugaaacccagcauguucgacguaucccgcgaacucggcucaucgguagcacucuacucuaggaaaguccucauacaaacaaaagccaccgacauccuaccaaaauggcuucgauucaucagaggcgucgucgacagugaagacaucccccucaaccucucacgagaacuccuacaagaauccgccuuaauccgaaaacuccgcgacguacuucaacagcgucucauaaaauucuucaucgaucaauccaagaaagaugcagaaaaauacgccaaauucuucgaagacuacggccucuucaugcgggaaggcaucguaacagcaaccgagcaagaggucaaagaggacauagcaaaacuccucagauacgaguccagcgcccuucccucgggccaacuaacuagccuaagcgaauacgccucacguaugagagcaggcacccgcaacaucuacuaccucugcgccccaaaccgacaccucgcagaacacucacccuacuacgaggccaugaaaaagaaagacaccgaaguccuguucugcuuugaacaauucgacgaacugacccuacuacaccucagagaguucgacaaaaagaaacucaucagcgucgagacggacaucgucguagaccacuacaaagaagaaaaauucgaggaccgcagcccagccgcagaaugccuaucggaaaaagaaaccgaagaacucauggccuggaugcggaacguccuaggcuccagaguaaccaacguaaaagucacacucagacuagacacccaccccgccauggucaccguacuagaaaugggagcugcccgacacuuccuacgaaugcaacaacuagcaaaaacacaggaggaacgcgcccaacuccuucaaccaacccucgaaauaaacccccgacacgcccuaauaaagaaacuaaaucaacugagggccuccgagcccggacucgcccaacuucuagucgaccagaucuacgaaaacgccaugaucgcggcaggccuaguagacgacccccgcgccauggugggacgacuaaaugaacuacuugucaaagcacuagagcgacauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7215 - RNA, 738 nt, Artificial Sequence
  mRNA product Design5 comprising derived and/or modified sequence from Homo sapiens__NP_000609.1__HsIGF1 (opt11)
gggagagucccgcagucggcguccagcggcucugcuuguucgugugugugucguugcaggccuuauucaagcuuaccaugggcaaaaucuccucccuccccacccaacucuucaaaugcugcuucugcgacuuccuaaaagucaaaaugcacaccauguccuccucccaccucuucuaccuagcccucugccuccuuaccuucaccuccuccgccaccgccggccccgaaacccucugcggcgccgaacucgucgacgcccuccaauuugucugcggcgaccgcggauucuacuucaacaaacccaccggcuacggcuccuccucccgccgcgcaccccaaaccggcaucgucgacgaaugcugcuuccgcuccugcgaccuccgccgccucgaaauguacugcgcaccccucaaacccgccaaauccgcccgcuccguccgcgcccaacgccacaccgacaugcccaaaacccaaaaagaaguccaccucaaaaacgccucccgcggcuccgccggcaacaaaaacuaccgcauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7216 - RNA, 819 nt, Artificial Sequence
  mRNA product Design5 comprising derived and/or modified sequence from Homo sapiens__NP_000603.1__HsIGF2 (opt11)
gggagagucccgcagucggcguccagcggcucugcuuguucgugugugugucguugcaggccuuauucaagcuuaccaugggcauccccaugggcaaauccaugcucguccuccuaaccuuccucgccuucgccuccugcugcaucgccgccuaccgacccuccgaaacacucugcggcggcgaacucgucgacacccuccaauucgucugcggcgaccgcggcuucuacuucucccgccccgccucccgcgucucacgccgcucccgcggcaucgucgaagaaugcugcuuccgcucuugcgaccucgcccuccucgaaaccuacugcgccacccccgcaaaauccgaacgcgacgucuccaccccccccacaguacuccccgacaacuucccccguuaccccgucggcaaauucuuccaauacgacaccuggaaacaauccacccaacgccuccgccgcggacuacccgcccuacuccgcgcccgccgcggccacguccuagcaaaagaacucgaagccuuccgagaagccaaacgccaccgcccccucaucgcccuccccacccaagaccccgcccacggaggcgccccccccgaaauggccuccaaccgcaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7217 - RNA, 915 nt, Artificial Sequence
  mRNA product Design5 comprising derived and/or modified sequence from Homo sapiens__NP_000591.1__HsIL6 (opt11)
gggagagucccgcagucggcguccagcggcucugcuuguucgugugugugucguugcaggccuuauucaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauucgaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuccuccaauccucccuccgcgcccuccgacaaauguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7218 - RNA, 1557 nt, Artificial Sequence
  mRNA product Design5 comprising derived and/or modified sequence from Homo sapiens__NP_002183.1__HsINHBA (opt11)
gggagagucccgcagucggcguccagcggcucugcuuguucgugugugugucguugcaggccuuauucaagcuuaccaugccacuccuguggcuccgcggauuccuccuagcaagcugcuggauaauaguacgaagcuccccaacaccaggcagcgagggccacagcgccgcacccgacugcccauccugcgcacucgccgcccucccaaaagacgucccgaacagccaacccgaaauggucgaagcggucaagaaacacauacucaacaugcuacaccuaaagaaacgcccagacguaacacagccaguccccaaagccgcacuacuaaacgcgauccgaaaacuacacguaggcaaagugggagaaaauggcuacgucgaaaucgaagacgacauaggcagacgagcagaaaugaacgaacuaauggaacaaacaagugaaauaaucacauucgccgagagcggcacagcccggaaaacccuacacuucgaaaucucaaaagaaggauccgaccucagcgucguagaacgagccgaaguguggcuauuccucaaaguccccaaagccaacagaaccagaaccaaagucacaaucagacucuuccaacagcaaaaacacccgcaaggaagccucgacacaggcgaagaagcagaggaagucggacucaaaggugaacgcagcgaacuccuccuguccgaaaaagucgucgacgcccgaaaaagcacauggcacguauucccaguaagcagcuccauccaacgccugcuagaccaagggaaaucaagccuggacguccgcauagcaugcgaacaaugccaagaaagcggcgcaagccuaguacuacuagggaaaaagaaaaagaaagaggaagaaggagaaggaaagaagaaaggaggcggagaagguggagcaggcgccgacgaagaaaaagaacaaagccaccggccauuccucaugcuacaagccagacaaagcgaagaccacccacaccgacgacgccgacgaggccucgaaugcgacggaaaagucaauauaugcugcaagaaacaauucuucgucagcuucaaagacauaggguggaacgacuggaucauagccccaagcggcuaccacgccaacuacugcgaaggagaaugcccaagccacaucgccggaacauccgggagcagccugagcuuccacagcacgguaauaaaccacuaccgcaugcgcggccacagcccauucgccaaccucaaaagcugcugcguacccaccaaacuacgcccaauguccaugcucuacuacgacgacgggcagaacaucauaaagaaagacauacagaacaugaucgucgaagagugcggcugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7219 - RNA, 1500 nt, Artificial Sequence
  mRNA product Design5 comprising derived and/or modified sequence from Homo sapiens__NP_002184.2__HsINHBB (opt11)
gggagagucccgcagucggcguccagcggcucugcuuguucgugugugugucguugcaggccuuauucaagcuuaccauggacggccuaccaggacgagcccucggcgccgcaugccuccuucuccucgccgccggaugguuaggccccgaagcauggggcucacccaccccaccacccaccccagccgcacccccacccccacccccaccaggauccccaggaggcagccaagacacaugcaccucgugcggaggcuucagacgcccugaagaacuaggccgagucgacggcgacuuccucgaagccgugaaacgccauauacucucccgacuccaaaugcgcggccgacccaacauaacccacgccguacccaaagcagcuaugguaaccgcccuccgcaaacuccaugccggcaaaguccgagaagacggccgagucgaaaucccccaccucgacggacacgccucccccggcgccgacggccaagaacgaguaucagaaaucaucuccuucgcugaaaccgacggccuggcauccucccgaguccgccucuacuucuuuauauccaacgaagguaaccaaaaccucuucgucguccaagccucacuauggcucuaccuaaaacuacuccccuacguacucgaaaaaggcagccgccgcaaaguccgcguaaaagucuauuuccaagaacaaggccacggcgaccgcuggaacaugguagaaaaacgugucgaccucaaaagaucaggcuggcacaccuucccccuaaccgaagcuauccaagcacucuucgaacgaggagaacgaagacucaaccucgacguacaaugcgacucuugccaagaacucgcgguagucccaguauucgucgaccccggcgaagaaucccacagacccuuuguaguaguacaagcgcgacucggcgacucucgacaccgaauccgcaaacgcggccuagaaugcgacggacgcacaaaccucugcugccgccaacaauucuucauagacuuccgccuaaucggcuggaacgacuggaucauagcccccaccggcuacuacggcaauuacugcgaaggcucaugccccgcauaccucgccggcguccccggcucagcauccucuuuccacaccgccgucguaaaccaauacaggaugcgcggacuuaacccaggaacagucaauuccugcugcauacccaccaaacucagcaccauguccaugcucuacuucgacgacgaauacaacaucgucaaacgcgacguccccaacaugaucgucgaagaaugcggaugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7220 - RNA, 3735 nt, Artificial Sequence
  mRNA product Design5 comprising derived and/or modified sequence from Homo sapiens__NP_000623.2__HsITGAM (opt11)
gggagagucccgcagucggcguccagcggcucugcuuguucgugugugugucguugcaggccuuauucaagcuuaccauggcccuccguguuuuacugcucacagcacucacacugugucacggauucaaccuagacaccgaaaaugcaaugaccuuccaagaaaacgcacgcggcuucggacaaucgguaguccaacuacaagguucgcgcguagucgucggcgccccucaagagauagucgcugcaaaccaacgaggcucacucuaccaaugcgacuacucaaccgggucaugcgaaccaaucagacuccaagucccagucgaagcagucaacaugagccugggucucagccucgccgccacaaccucacccccacaacucuuagcaugcggaccaaccguccaucagaccugcucggaaaacaccuacguaaaaggccuaugcuuucucuuuggguccaaccuacgacagcagccccaaaaauuccccgaagcccuccgaggauguccgcaagaagacagcgacauagccuuucucauugacggcuccggauccauaauaccacacgacuuccgccggaugaaggaauuugucucaacaguuauggaacaacucaagaaauccaaaacacucuucucccugaugcaauacagcgaggaguucagaauccacuucaccuucaaagaguuccagaacaaccccaacccccgcucacugguaaaaccaauaacucaacuccucggcaggacacacacggccacgggcaucaggaaggucgugcgcgaacucuucaacauaacaaauggugcacgcaaaaacgccuucaaaauccuuguggucauaaccgacggcgaaaaauucggggacccauuaggauacgaagacguaauccccgaagcggacagagagggaguaauccgauacgucaucggcguuggggacgccuuccguagcgaaaaaucccgccaggaacucaacacaauugccuccaaaccgccccgagaccacgucuuccaagucaacaacuucgaagcccucaaaaccauccaaaaccaacuccgagagaaaauauucgccauagaaggaacccaaaccggcagcuccagcuccuucgaacaugaaaugucccaagaaggcuucagcgccgcgaucaccuccaacggcccucuacucucuaccgucggaucauacgacugggcuggcggcgucuuccuuuacaccuccaaggaaaaaucgacauucaucaacaugaccagagucgauucugacaugaacgacgcauaucucggcuacgccgcugcuaucauucuacgcaacagagugcaaucucuaguauuaggagccccucguuaccaacacaucggccuaguggcaauguuccgucaaaacaccgggaugugggaaagcaacgcgaacgucaagggcacccaaaucggcgcauacuucggagcuucucucugcucuguggacgucgacucaaacggaagcacugaucucguucuuaucggagcaccccacuacuaugagcagacucgaggaggccaaguaucagucuguccacucccccguggccgagcccgcuggcaaugcgacgcgguucuauauggcgaacaaggucaacccuggggcagguucggugccgcgcucaccguccuuggagacgucaacggcgacaaacucaccgacguagcaaucggcgcaccuggcgaggaagacaaccgcggcgcaguguaccucuuccacggcaccuccggcagcggcaucucacccucccacucacaacgcauagccggcucuaaacugucccccagacugcaauacuucgggcaaagccuauccgguggacaagaccucacgauggacggccuaguagaucugacgguuggcgcgcaagggcauguacuucuacuacgaucccaaccaguacuacgugucaaggcaaucauggaguucaauccacgggaagucgcacgaaacgucuucgaaugcaacgaccaaguugucaagggcaaagaagccggcgaagucagagugugucugcacguacaaaagagcacacgugaucgacugcgagaaggacaaauccaguccguggucaccuacgaccuagcccuagacuccggaagaccccacagccgugccgucuucaacgaaaccaaaaauucaacccgccggcaaacccaggugcuaggccuuacccaaacuugcgagacgcucaaacuacaacugcccaacuguaucgaagacccagucucaccaaucguacuacgccuuaauuuuucccuagucggcacaccccucucagcauucggaaaccuccgacccguccucgccgaagacgcccaacgacuuuucaccgcccuauuccccuucgaaaagaacugcggcaacgacaacauaugucaagacgaccucagcaucaccuucucuuucaugucgcucgacugccuagugguaggcggaccccgagaauuuaacgucacagucaccguaagaaacgacggagaggauuccuacagaacgcaaguuacauucuucuucccgcucgaccucucguaccgcaaagucucgacccuucaaaaccaacgaucucaacgaucuuggaggcucgcaugugaaucagccucgucaacagaaguaaguggcgcccucaaaucgaccuccuguuccauaaaccacccaaucuuccccgagaacagcgaagucacauucaacauaacauucgacguugacucuaaagcaucacucggcaacaaacucuuacugaaagccaacgucaccagcgaaaacaacaugccaagaacaaacaaaacagaguuccaacucgaacucccagucaaguaugccguauacauggucgucaccagccacggaguauccacaaaauaccucaacuuuaccgccagcgaaaacacguccagaguaaugcaacaccaauaccagguauccaaccuuggucaacgcagucuacccaucucccuaguguuccucguucccgucagacuaaaccagacaguaauaugggaccguccacaaguaacauucucugaaaaccucuccuccacaugucacacuaaagaacgacucccuagccauuccgacuuucuugcagagcuucgcaaagccccuguugugaacugcucaaucgcgguaugccagcgcauacagugcgacauaccauucuuugggauacaggaagaguucaacgcgacucucaaagguaaccucagcuucgacugguauaucaagaccucacauaaccaccuccuaauaguauccacagccgaaauccucuucaacgacagcgucuucacauugcugcccggccaaggagcuuucguacgaucgcagacagaaacuaaaguagaaccuuucgaagucccgaacccgcucccgcuaaucgucggauccuccguuggcgggcuacuccuucuugcccucaucacagcagcacuguauaagcucggcuucuucaagcgccaauacaaagauaugauguccgaaggcggcccgcccggggccgaaccccaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7221 - RNA, 1680 nt, Artificial Sequence
  mRNA product Design5 comprising derived and/or modified sequence from Homo sapiens__NP_002415.1__HsMMP8 (opt11)
gggagagucccgcagucggcguccagcggcucugcuuguucgugugugugucguugcaggccuuauucaagcuuaccauguucucccucaaaaccuuaccguuccuccuacuacuacacguccaaaucuccaaagccuucccugucuccagcaaagagaaaaacacuaaaaccguacaggacuaccucgaaaaauucuaccaacuacccucaaaccaguaccaguccacccgcaaaaacggcacaaacgugaucgucgaaaagcuaaaagaaaugcaacgcuucuucggccuaaacgucacaggcaaacccaacgaagaaacccucgacaugaugaagaaaccccgaugcggcguccccgacuccggcggcuucaugcucacacccgguaaccccaaaugggaacgaaccaaccuaaccuaccgcauacgaaacuacacaccccaacucucagaagccgaagucgaacgagcuaucaaagacgcauuugaacucugguccgucgcaucaccccucaucuucacccgcaucucucaaggcgaagccgacauaaauaucgccuucuaucaaagagaccacggcgacaacucccccuucgacggcccgaacgguauccucgcacacgccuuccaaccaggccaaggaaucggcggcgaugcccacuucgacgcagaagaaaccuggacaaacaccucagccaacuacaaccucuuccucgucgccgcgcacgaguucggacauucccucggccuagcccacuccuccgaccccggugcacucauguacccaaacuacgccuuccgcgaaaccagcaacuacucacucccccaagacgacauagacggcauccaagccauauacggacuaucauccaaccccauccagccaaccggacccucaacccccaaacccugcgauccaucccucaccuucgacgccaucaccacccuacguggagagauccucuucuucaaagaucgauauuucuggcgccgacacccccaacugcaacggguugaaaugaacuucaucagccucuucuggccuucacuacccaccggaauccaagccgccuaugaagacuuugaccgcgaccucaucuuccucuucaaaggaaaccaauacugggcccucucggguuacgacauccuucaaggcuacccuaaagacauaucaaacuacggauucccaucguccguccaagccaucgaugccgcaguuuucuaccgcuccaaaaccuacuucuucgucaacgaccaauucuggcgcuaugacaaccaacgccaauucauggaaccaggauaccccaaauccaucuccggcgccuuccccggcaucgaaagcaaagucgacgcagucuuccaacaagaacacuucuuccacguuuucucaggcccucgcuacuacgccuucgaccuaaucgcccaacgagucacccgagucgcccgaggaaacaaauggcuuaacugccgcuacggauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7222 - RNA, 2400 nt, Artificial Sequence
  mRNA product Design5 comprising derived and/or modified sequence from Homo sapiens__NP_004985.2__HsMMP9 (opt11)
gggagagucccgcagucggcguccagcggcucugcuuguucgugugugugucguugcaggccuuauucaagcuuaccaugucccucuggcaaccucucguauuaguacuccuaguccuuggaugcugcuuugccgcuccucgacaacgccaauccacacucguccuuuucccaggggaucuaagaaccaaccuuaccgaccggcaacuagcagaggaauaccuauaccgcuauggauacacaagagucgccgaaaugagaggagaaucgaaaagccucggaccagcccuccuacuacuacaaaaacaacucucccugcccgaaacuggcgaacucgacucugccacucuaaaagcaaugaggaccccacgaugcggcguccccgaccuaggcagauuccaaaccuucgaaggcgaucuaaaauggcaccaccacaacauaaccuacuggauccaaaacuacucagaagaccucccccgagccguaauagacgaugccuucgcaagagcuuucgcccucuggucggcagucacuccccucaccuuuaccagaguauacucccgagacgccgacauagucauccaauucggcgucgccgaacacggcgacggcuaccccuucgacggaaaagauggacuccucgcucacgcguucccaccaggcccagguauccaaggcgaugcucacuucgacgacgacgaacuauggucucucggaaaaggggucgucguccccacccgauucggaaacgcagacggcgccgcuugccacuuccccuucaucuucgaaggacguuccuacagcgccugcacgaccgacggaagauccgauggacuaccauggugcucaacgaccgccaacuacgacacagacgacagauucggauucugucccucagaacgucucuacacacaagacggcaacgccgauggcaaacccugccaauuccccuucauauuccaaggccaauccuacuccgccugcacaaccgacggacgcucugacggcuaccgauggugcgcuacaacagcaaacuaugaucgagacaaguuauuuggauucugccccacccgcgccgauuccaccguaaugggugggaacuccgcaggagaacucugcgucuuccccuucaccuuccucggaaaagaguacagcacaugcaccuccgaaggccgaggcgacggccgccuauggugcgccaccaccuccaacuuugacucagacaagaaaugggguuucugccccgaccaagguuacagccucuuccucgucgccgcacaugaauuuggacacgcauuaggccuagaccacucgucaguccccgaagcccucauguaccccauguacagauucacugaaggcccaccccuccacaaagacgacgucaacggaauccgccaucucuacggcccccgaccagaaccugaaccacgcccacccacaaccaccacaccccaacccaccgccccacccacugucugccccaccggcccacccaccguccaucccagcgagagacccaccgcgggcccaaccggcccacccuccgcaggccccacuggacccccaaccgcaggacccuccaccgcuacuaccguuccacuauccccagucgacgacgcuugcaacgucaacaucuucgacgccauagcugagauaggaaaccagcucuaccuauucaaagacggaaaauacuggcgauucuccgagggacgcggcucccgcccccaaggaccauuucuaauagcagacaaguggcccgcacucccacgcaaacuugacuccguuuucgaggaaagacucuccaagaaacuauucuucuuuuccggccgacaagucuggguuuacacaggcgccuccguacucgguccucgccgccuugacaaacuagggcucggcgcagacgucgcccagguaacaggagcucuccgaagcggaaggggcaaaauguuacucuucuccggccgucgacucuggcgauucgacguaaaagcccaaaugguagaucccagaagcgccagcgaagucgaccgcauguucccaggagucccccuugauacccacgacgucuuccaauaccgcgaaaaagccuacuuuugccaagaccgcuucuacuggcgcgucucuagcagaucagaacuuaaccaaguagaccaaguaggcuacgucaccuacgacauccuacagugcccagaagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7223 - RNA, 1692 nt, Artificial Sequence
  mRNA product Design5 comprising derived and/or modified sequence from Homo sapiens__NP_002418.1__HsMMP13 (opt11)
gggagagucccgcagucggcguccagcggcucugcuuguucgugugugugucguugcaggccuuauucaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauucggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7224 - RNA, 1344 nt, Artificial Sequence
  mRNA product Design5 comprising derived and/or modified sequence from Homo sapiens__NP_001286.1__HsCCR1 (opt11)
gggagagucccgcagucggcguccagcggcucugcuuguucgugugugugucguugcaggccuuauucaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuaccuacucaaccuugccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccuccuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaaucccuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgacuagaacgcgucuccuccacaagcccaagcaccggcgaacacgaacucuccgccggcuucuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7225 - RNA, 912 nt, Artificial Sequence
  mRNA product Design5 comprising derived and/or modified sequence from Homo sapiens__NP_002598.4__HsPDGFA (opt11)
gggagagucccgcagucggcguccagcggcucugcuuguucgugugugugucguugcaggccuuauucaagcuuaccaugcgcacacucgccugccuccuacuccucggcugcggcuaccucgcacacguccucgccgaagaagccgaaaucccccgagaagucaucgaacgacucgcccgcucccaaauccacuccauccgcgaccuccaacgccuccucgaaaucgacuccgucggcuccgaagacucccucgacaccucacuccgcgcccacggaguccacgccaccaaacacguacccgaaaaacgaccccuccccauccgccgaaaacgcuccauagaagaagccguccccgccgucugcaaaacccgcaccgucaucuacgaaaucccccgcucccaagucgaccccacauccgccaacuuccucaucuggccccccugcguagaagucaaacgcugcaccggcugcugcaacacauccuccguaaaaugccaacccucccgcguacaccaccgcuccgucaaagucgccaaagucgaauacguccgcaaaaaacccaaacuaaaagaaguccagguccgccucgaagaacaccucgaaugcgccugcgccaccaccucccucaacccagacuaccgcgaagaagacaccggccgcccccgcgaauccggcaaaaaacgcaaacgcaaacgccugaaacccaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7226 - RNA, 1002 nt, Artificial Sequence
  mRNA product Design5 comprising derived and/or modified sequence from Homo sapiens__NP_002599.1__HsPDGFB (opt11)
gggagagucccgcagucggcguccagcggcucugcuuguucgugugugugucguugcaggccuuauucaagcuuaccaugaaccgaugcugggcccucuuccucagccucugcugcuaccuacgacuuguaucagccgaaggcgacccaaucccagaagaacuauacgaaaugcuguccgaccacuccauccgcuccuucgacgaccuccaacgccuccuccacggugaccccggcgaagaagacggcgccgaacuagaccuuaauaugacccgcucccacuccggcggagaacucgaaucacucgcccgcggacgccgcucccuaggcucccucaccaucgccgaaccagccaugaucgccgaaugcaaaacacgcaccgaaguauucgaaaucucacgccgacucaucgaccgcaccaacgccaacuuccuugucuggcccccaugcgucgaaguccaacgcugcuccggcugcugcaacaaccgcaacguacaaugccgacccacacaaguacaacuccgcccaguccaaguacgcaaaaucgaaaucguccgcaaaaaaccaaucuucaaaaaagccacagucacccucgaagaccaccucgccugcaaaugcgaaaccguagccgccgcacgccccgucacccgcucacccggcggaucacaagaacaacgugcaaaaaccccccaaacccgcgucacaauccgcaccguccgcguccgccgcccccccaaaggaaaacaccgcaaauucaaacacacacacgacaaaaccgcccucaaagaaacccuaggcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7227 - RNA, 1314 nt, Artificial Sequence
  mRNA product Design5 comprising derived and/or modified sequence from Homo sapiens__NP_057289.1__HsPDGFC (opt11)
gggagagucccgcagucggcguccagcggcucugcuuguucgugugugugucguugcaggccuuauucaagcuuaccaugagccucuucggccuccuccuccucaccuccgcccuggccggccagcgccaaggcacccaggccgaauccaaccucuccuccaaauuccaauucuccuccaacaaagaacaaaacggcguccaagacccccaacacgaacgaaucaucaccgucucaacaaacggcucaauacacucaccacgcuucccccacaccuacccaagaaacaccguccucgucuggcgccuagucgccgucgaagaaaacguauggauccaacucaccuucgacgaacgcuucggccucgaagacccagaagacgacaucugcaaauacgacuucguagaagucgaagaaccuagcgacggcaccauacucggacguuggugcggcuccggcaccguccccggcaaacaaaucuccaaaggcaaccaaauccgaauacgcuucguauccgacgaauacuucccauccgaacccggcuucugcauccacuacaacaucgucaugccccaauucaccgaagccgucucccccuccguacuaccccccuccgcccucccccucgaucuucucaacaacgccaucacggccuucuccacccucgaagaccuaauacgcuaccuggaacccgaaagauggcaacucgaucucgaagaucuauaccgccccacauggcaacuccucggcaaagccuucgucuucggcagaaaaucccgggucguagaccucaaccuccucaccgaagaaguacgccuauacuccugcacaccacgcaacuucuccguauccauccgagaagaacucaaacgcaccgacacuaucuucuggcccggcugccuccucgucaaaagaugcggcggaaacugcgccugcugucuccacaacugcaacgaaugccaaugcguccccuccaaaguaaccaaaaaauaccacgaaguccuacaacuucgcccaaaaaccggcguaagaggccuccacaaaucccucaccgacgucgcacuagaacaccacgaagaaugcgacugcgucugccgcggcuccaccggaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7228 - RNA, 1371 nt, Artificial Sequence
  mRNA product Design5 comprising derived and/or modified sequence from Homo sapiens__NP_149126.1__HsPDGFD (opt11)
gggagagucccgcagucggcguccagcggcucugcuuguucgugugugugucguugcaggccuuauucaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauucgacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagagcuaaaacucgccaacguagucuucuucccccgcugccuucucguccaaagaugcggcggcaacugcggcuguggaaccguaaacuggcgcagcugcaccugcaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7229 - RNA, 954 nt, Artificial Sequence
  mRNA product Design5 comprising derived and/or modified sequence from Homo sapiens__NP_003946.3__HsSOCS3 (opt11)
gggagagucccgcagucggcguccagcggcucugcuuguucgugugugugucguugcaggccuuauucaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuccucgaccaauacgaugcaccccuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7230 - RNA, 759 nt, Artificial Sequence
  mRNA product Design5 comprising derived and/or modified sequence from Homo sapiens__NP_003227.1__HsTGFA (opt11)
gggagagucccgcagucggcguccagcggcucugcuuguucgugugugugucguugcaggccuuauucaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugccgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccugcguccuaauccacugcugccaaguccgcaaacacugcgaauggugccgcgcccucaucugccgccacgaaaaacccuccgcccuccucaaaggccgcaccgccugcugccacuccgaaacagucguuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7231 - RNA, 1449 nt, Artificial Sequence
  mRNA product Design5 comprising derived and/or modified sequence from Homo sapiens__NP_000651.3__HsTGFB1 (opt11)
gggagagucccgcagucggcguccagcggcucugcuuguucgugugugugucguugcaggccuuauucaagcuuaccaugccucccucuggccuucgacugcucccccuccuccucccccuccuauggcuccuaguccuaacacccggccgcccagccgcaggccucuccacaugcaaaacaauagacauggaacucgucaaacgaaaacgcaucgaagcaauccgcggccaaauacucucuaaacuucgccucgccucaccacccucccaaggcgaagucccaccaggaccccuccccgaagccguauuagcucucuacaacuccacacgcgaccgcgucgcaggcgagagcgccgaacccgaacccgaaccugaagcugacuacuacgccaaagaaguaacacgcguccucaugguugaaacccacaacgaaaucuaugacaaauucaaacaauccacccacucaaucuacauguucuuuaacacaucagaacuccgcgaagccguccccgaaccaguccuccuuucccgugccgaacuccgccuacugcgccucaaacuaaaaguagaacaacacguugaacucuaccaaaaauacucaaacaauuccuggcgauaccucuccaaccgccuccucgcccccuccgacagccccgaauggcucucuuuugacgucacaggcgucguacgccaauggcucucaagaggcggcgaaaucgaaggcuuccgccucucagcccauugcucuugcgacucucgcgacaacacccuccaagucgacaucaacggcuucaccaccggccgacgcggcgaccucgccaccauccacggcaugaaccguccuuuccuacuucuaauggccacaccccucgaacgcgcccaacaccuccaaucaucacgccacagacgcgcccucgacaccaacuacugcuucuccuccaccgaaaagaacugcugcguacgccaacucuacaucgacuuccguaaagaccucggcuggaaauggauccacgaacccaaaggcuaccacgccaacuucugucuuggcccaugccccuacaucuggucccuagacacucaauacuccaaaguccuagcccuuuacaaccaacacaaccccggcgcaucagccgcccccugcugcguaccccaagcccucgaaccacuccccauagucuacuacguaggccgaaaacccaaagucgagcaacuauccaacaugaucguccggucgugcaaaugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7232 - RNA, 1521 nt, Artificial Sequence
  mRNA product Design5 comprising derived and/or modified sequence from Homo sapiens__NP_003229.1__HsTGFB2 (opt11)
gggagagucccgcagucggcguccagcggcucugcuuguucgugugugugucguugcaggccuuauucaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuccgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagagcuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7233 - RNA, 1515 nt, Artificial Sequence
  mRNA product Design5 comprising derived and/or modified sequence from Homo sapiens__NP_003230.1__HsTGFB3 (opt11)
gggagagucccgcagucggcguccagcggcucugcuuguucgugugugugucguugcaggccuuauucaagcuuaccaugaaaaugcaccuccaacgagcccuagucguccucgcacuacucaacuucgcaaccgucucccuaagccuuuccacaugcaccacccuggacuucggccacaucaaaaagaaacgugucgaagccauucgaggccaaauacucagcaaacuccgccucacaucacccccagaacccacaguuaugacccacguccccuaccagguccuagcccuauacaacagcacccgcgaacuccucgaagaaaugcacggcgaacgcgaagaaggcugcacccaagaaaauacagaguccgaauauuaugcaaaagaaauccacaaauucgacaugauccagggccucgccgaacacaacgagcucgccgucugucccaaaggcaucaccuccaaaguauucagauucaacgugucauccgucgagaaaaaccgcaccaaccucuuccgcgccgaguuccguguccuccgcgucccaaaccccuccagcaaacgaaacgaacaacgaauagaacuauuccagauccuccgccccgacgaacacaucgccaaacaacgcuacauugggggcaaaaaccuccccacccgcggaacagccgaauggcuauccuucgacgucaccgacaccguccgcgaauggcuacuaagaagagaauccaaccucggccucgaaaucuccauacacugccccugccacaccuuccaacccaacggagacauacucgaaaacauccacgaaguaauggaaaucaaguucaaaggagucgacaacgaagacgaccacggccgcggcgaccuaggccgccucaaaaagcagaaagaccaccacaacccccaccuaauacuaaugaugauacccccucaccgccucgacaaccccggccaaggcggacaacgcaaaaagcgcgcccucgacacuaacuacugcuuccgcaaccucgaagaaaacugcugcguccgcccccucuacaucgacuuccgccaagaccucggguggaaauggguacacgaacccaaaggcuacuacgccaacuucugcagcggaccaugcccauaccucagaagcgcagacacaacacacuccaccguccucggccucuacaacacccuaaaccccgaagccucagccucccccugcugcguaccacaagaccuugaaccacucaccauccucuauuacguaggccgcacccccaaagucgaacaacucucaaacauggucguaaaaucaugcaaaugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7234 - RNA, 1662 nt, Artificial Sequence
  mRNA product Design5 comprising derived and/or modified sequence from Homo sapiens__NP_001057.1__HsTNFRSF1B (opt11)
gggagagucccgcagucggcguccagcggcucugcuuguucgugugugugucguugcaggccuuauucaagcuuaccauggcaccagucgcagucugggccgcccucgccguaggccuugaacucugggcagccgcccacgcccucccagcacaagucgcauucacucccuacgcacccgaacccggcuccaccugccgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcuugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccugcucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccugcaucgugaacguuuguuccuccucagaucacagcucccaaugcucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7235 - RNA, 789 nt, Artificial Sequence
  mRNA product Design5 comprising derived and/or modified sequence from Homo sapiens__NP_002623.2__HsPGF (opt11)
gggagagucccgcagucggcguccagcggcucugcuuguucgugugugugucguugcaggccuuauucaagcuuaccaugccggucaugcgccuguucccgugcuuucuccagcuacuggccgggcucgcgcucccggccgugcccccgcaacaaugggcgcucucggccggaaacgggagcucggaaguggaaguggucccguuccaggaagugugggggcgcucguacugucgagcgcucgagcgcuuggucgaugucgugagcgaguacccgagcgaggucgagcacauguucucgcccucgugcgugagcuugcuaaggugcacgggauguugcggggacgagaacuugcacuguguaccggucgagaccgcgaacgugaccaugcaauugcucaagaucaggagcggggacaggcccucguacguggaauugaccuuuagccagcacgugcgcugugaaugucgcccgcucagggaaaagaugaagccagagcgcaggcgcccgaaagggcgagggaaaaggcgcagggaaaagcaaagacccacggacugucacuugugcggggacgcggucccgaggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7236 - RNA, 1515 nt, Artificial Sequence
  mRNA product Design5 comprising derived and/or modified sequence from Homo sapiens__NP_001020537.2__HsVEGFA (opt11)
gggagagucccgcagucggcguccagcggcucugcuuguucgugugugugucguugcaggccuuauucaagcuuaccaugaccgauagacagaccgacacagcgcccucacccucguaccaucucuugccggggaggaggagaacgguagacgcggcggcaucgcgcgggcaagggccggaaccagcgccagggggaggagucgaaggagugggagcgagaggggucgcgcuaaaacucuucguccaacugcugggaugcagcagguucgggggagcagugguaagagcaggagaggcagagccaucgggcgcggcaaggagcgcaagcucgggaagggaggaaccacagccagaagaaggggaagaggaagaggaaaaggaagaagaaaggggaccacaauggagacuaggcgcgagaaagccagggagcuggacaggggaggcggccgugugcgcggacucggcaccagccgcaagagcgccgcaggcacuagcaagggccucgggaaggggaggaaggguggcaagacgaggagccgaggaaucaggaccaccacacagcccaagcaggcgagggagcgcgagcagggcagggcccgggagagcaagcgagacaaugaacuuucucuugagcuggguacauuggucgcuagcgcuccuacuguaucugcaccacgcgaaauggagccaggcagcgccaauggcagagggaggagggcagaaccaccacgaagucgugaaauucauggauguauaccaaaggagcuacugccacccaauagaaacgcuaguagacauauuccaggaauauccagaugaaauugaauacauauucaaaccgagcugcguaccacucaugagguguggcggaugcuguaacgaugaagggcuagagugcgugccaacagaagagagcaacauaacaaugcaaauaaugcgaauaaaaccacaccaaggacagcacauaggagagaugagcuuccuacaacacaacaagugcgagugcaggccaaagaaagacagagcgcgccaagaaaagaaaagcguaaggggaaaggggaagggacagaaaaggaaaaggaaaaagaguagauacaaaaguuggagcguauacguaggagcgagaugcugcuugaugccguggucacuaccgggaccacacccgugugggcccugcagcgagagacgaaaacaccuauucgugcaggacccgcagacgugcaagugcucguguaagaacacggacucgaggugcaaagcgagacagcuagagcugaaugaaaggaccugccgaugugacaagcccagaagguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7237 - RNA, 975 nt, Artificial Sequence
  mRNA product Design5 comprising derived and/or modified sequence from Homo sapiens__NP_001165094.1__HsVEGFA (opt11)
gggagagucccgcagucggcguccagcggcucugcuuguucgugugugugucguugcaggccuuauucaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugccgcugcgacaaaccccgacgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7238 - RNA, 900 nt, Artificial Sequence
  mRNA product Design5 comprising derived and/or modified sequence from Homo sapiens__NP_003368.1__HsVEGFB (opt11)
gggagagucccgcagucggcguccagcggcucugcuuguucgugugugugucguugcaggccuuauucaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugccaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7239 - RNA, 1536 nt, Artificial Sequence
  mRNA product Design5 comprising derived and/or modified sequence from Homo sapiens__NP_005420.1__HsVEGFC (opt11)
gggagagucccgcagucggcguccagcggcucugcuuguucgugugugugucguugcaggccuuauucaagcuuaccaugcaccuccuaggcuucuucagcguugccugcucccuacuggccgccgcccuccucccuggcccccgcgaagcucccgcagccgcagcagccuuugaaucaggucucgaccuuagcgacgcagaacccgacgccggagaagcuaccgccuacgcgagcaaagaccucgaagaacaacugcgauccgucuccuccgucgacgaacucaugacuguacucuaccccgaauacuggaaaauguacaaaugccaacuccggaaaggaggcuggcaacacaacagagaacaagccaaccucaacucccgaaccgaagaaacuaucaaauucgccgcagcccacuacaacaccgaaauacucaaaucaaucgacaacgaauggagaaaaacccaaugcaugccccgagaagucugcaucgacgucggcaaagaguucggagucgccaccaacacauucuucaaaccaccuuguguauccgucuaccgaugcggagguugcugcaacuccgaaggccuacaaugcaugaacaccuccaccucauaccucucaaaaacacucuucgaaaucaccgucccccuaagccaaggcccgaaaccagucaccauuuccuucgcaaaccauacaucaugccgauguaugucaaaacucgacgucuaccgccaaguccacuccauaauccgacgcucacucccagccacccucccccaaugccaagcagcaaacaaaaccugcccaaccaacuacauguggaacaaccacaucugccgcugccucgcacaagaagacuucauguucagcuccgacgccggcgacgacuccaccgacggcuuccacgacaucugcggccccaacaaagaacucgacgaagaaacaugccaaugcguuugucgcgccggccuccgcccagccuccugcggaccacacaaagaacucgacagaaacuccugccaaugcguuugcaaaaacaaacuauucccaucccaaugcggagccaaccgcgaguucgacgaaaauaccugccaaugcguaugcaaacgaaccugcccccgaaaccaaccccuaaaccccggcaaaugcgcuugcgaaugcaccgaauccccgcaaaaaugccuccucaaaggaaagaaauuccaccaccaaaccugcuccugcuaccgccgacccugcaccaaccgucaaaaagcgugcgaacccggauucuccuacuccgaagaagucugccgcugcguccccagcuacuggaaacgcccccaaauguccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7240 - RNA, 1341 nt, Artificial Sequence
  mRNA product Design5 comprising derived and/or modified sequence from Homo sapiens__NP_004460.1__HsVEGFD (opt11)
gggagagucccgcagucggcguccagcggcucugcuuguucgugugugugucguugcaggccuuauucaagcuuaccauguaccgagaaugggucgucgucaacguauucaugaugcucuacguacaacucguccaaggcagcagcaacgaacacggccccgucaagagauccagccaaagcacccuagaacgauccgaacaacaaauacgcgcagccucaagccucgaagaguuacuacgaaucacccacucagaagacuggaagcucuggcgaugccgccuccgccucaaguccuucaccuccauggacagcagaucagccucccaccgcucaacccguuucgccgccaccuucuacgacaucgaaacccucaaagucaucgacgaggaauggcaacgaacacaaugcucucccagagaaaccugcguagaagucgccuccgaacuugguaaaucaaccaacacuuucuucaaaccacccugcgucaacgucuuccgcugcggaggcugcugcaacgaagagucccucauaugcaugaacacauccaccuccuacaucuccaaacaacucuucgaaauauccguaccccuaaccuccgucccagaacuuguacccgucaaagucgccaaccacaccggcugcaaaugccuccccacagcaccccgccaccccuacuccauaauccgccgaucgauacaaauaccggaagaagaccgcugcucacacucaaagaaacucugccccauagacaugcucugggacuccaacaaaugcaaaugcguccuccaggaagaaaacccccuagccggcacagaagaccacucccaccuccaagaaccagcccucugcggcccccauaugauguucgacgaagaccgcugcgaaugcguaugcaaaacccccugccccaaagaccucauccaacaccccaaaaacugcucaugcuucgaaugcaaagaaucacucgaaaccugcugccaaaaacacaaacucuuccaccccgacacaugcucaugcgaagaccgaugccccuuccacacccgccccugcgccuccggcaaaaccgccugcgccaaacacugccgauucccaaaagaaaaacgcgccgcccaaggcccccacucacgcaaaaauccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7241 - RNA, 906 nt, Artificial Sequence
  mRNA product Design5 comprising derived and/or modified sequence from Homo sapiens__NP_061986.1__HsFGF21 (opt12)
gggagagucccgcagucggcguccagcggcucugcuuguucgugugugugucguugcaggccuuauucaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7242 - RNA, 1686 nt, Artificial Sequence
  mRNA product Design5 comprising derived and/or modified sequence from Homo sapiens__NP_002412.1__HsMMP1 (opt12)
gggagagucccgcagucggcguccagcggcucugcuuguucgugugugugucguugcaggccuuauucaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7243 - RNA, 1446 nt, Artificial Sequence
  mRNA product Design5 comprising derived and/or modified sequence from Homo sapiens__NP_002412.1__HsMMP1(1-19,100-469) (opt12)
gggagagucccgcagucggcguccagcggcucugcuuguucgugugugugucguugcaggccuuauucaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7244 - RNA, 3633 nt, Artificial Sequence
  mRNA product Design5 comprising derived and/or modified sequence from Clostridium histolyticum__BAA77453.1__ColG (opt12)
gggagagucccgcagucggcguccagcggcucugcuuguucgugugugugucguugcaggccuuauucaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7245 - RNA, 3357 nt, Artificial Sequence
  mRNA product Design5 comprising derived and/or modified sequence from Clostridium histolyticum__BAA77453.1__HsALB(1-18)_ColG(111-1118) (opt12)
gggagagucccgcagucggcguccagcggcucugcuuguucgugugugugucguugcaggccuuauucaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7246 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt12)
gggagagucccgcagucggcguccagcggcucugcuuguucgugugugugucguugcaggccuuauucaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7247 - RNA, 3381 nt, Artificial Sequence
  mRNA product Design5 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7248 - RNA, 3342 nt, Artificial Sequence
  mRNA product Design5 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7249 - RNA, 3276 nt, Artificial Sequence
  mRNA product Design5 comprising derived and/or modified sequence from Clostridium histolyticum__BAA34542.1__HsALB(1-18)_ColH(41-1021) (opt12)
gggagagucccgcagucggcguccagcggcucugcuuguucgugugugugucguugcaggccuuauucaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7250 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt12)
gggagagucccgcagucggcguccagcggcucugcuuguucgugugugugucguugcaggccuuauucaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7251 - RNA, 852 nt, Artificial Sequence
  mRNA product Design5 comprising derived and/or modified sequence from Homo sapiens__NP_001133.1__HsAMELX (opt12)
gggagagucccgcagucggcguccagcggcucugcuuguucgugugugugucguugcaggccuuauucaagcuuaccaugggaacauggauacuuuucgcaugccuacucggagcagcauucgcaaugccacuaccaccacacccaggacacccaggauacauaaacuucucauacgaaguacuaacaccacuaaaaugguaccaaucaauaagaccaccauacccaucauacggauacgaaccaaugggaggaugguuacaccaccaaauaauaccaguacuaucacaacaacacccacccacacacacauuacaaccacaccaccacauaccaguaguaccagcacaacaaccaguaauaccacaacaaccaaugaugccaguaccaggacaacacuccaugacaccaauacaacaccaccaaccaaaccuaccaccaccagcacaacaaccauaccaaccccaaccaguacaaccacaaccacaccaaccaaugcaaccacaaccaccaguacacccaaugcaaccacuaccaccacaaccaccacuaccaccaauguucccaaugcaaccacuaccaccaaugcucccagaccuaacacuagaagccuggccaucaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7252 - RNA, 411 nt, Artificial Sequence
  mRNA product Design5 comprising derived and/or modified sequence from Homo sapiens__NP_001133.1__HsAMELX-TRAP (opt12)
gggagagucccgcagucggcguccagcggcucugcuuguucgugugugugucguugcaggccuuauucaagcuuaccaugccucuaccuccacauccaggucacccuggauauauaaauuucucuuacgaaguacuuacaccucuaaaaugguaucaaucuauacguccaccuuacccuucauauggauaugaaccuauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7253 - RNA, 444 nt, Artificial Sequence; identical to SEQ ID NO: 6793
  mRNA product Design5 comprising derived and/or modified sequence from Homo sapiens__NP_001133.1__HsAMELX-LRAP (opt12)

SEQ ID NO: 7254 - RNA, 483 nt, Artificial Sequence; identical to SEQ ID NO: 6794
  mRNA product Design5 comprising derived and/or modified sequence from Homo sapiens__NP_001133.1__HLA-A2-SP_HsAMELX(17-60) (opt12)

SEQ ID NO: 7255 - RNA, 516 nt, Artificial Sequence
  mRNA product Design5 comprising derived and/or modified sequence from Homo sapiens__NP_001133.1__HLA-A2-SP_HsAMELX(17-47,168-191) (opt12)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7256 - RNA, 855 nt, Artificial Sequence
  mRNA product Design5 comprising derived and/or modified sequence from Homo sapiens__NP_001134.1__HsAMELY (opt12)
gggagagucccgcagucggcguccagcggcucugcuuguucgugugugugucguugcaggccuuauucaagcuuaccaugggaacauggauccuauucgcuugccuaguaggagcagcauucgccaugccauuaccaccacacccaggacacccaggauacauaaacuucucauacgaaguacuaacaccacucaaaugguaccaaucaaugauaagaccaccauacucaucauacggauacgaaccaaugggaggauggcuacaccaccaaauaauaccaguaguaucacaacaacacccauuaacacacacacuacaaucacaccaccacauaccaguaguaccagcacaacaaccaagaguaagacaacaagcacucaugccaguacccggacaacaaucaaugacaccaacacaacaccaccaacccaaccuaccacuaccagcacaacaaccauuccaaccacaaccaguccaaccacaaccacaccaaccaaugcaaccacaaccaccuguacaaccaaugcaaccacuauuaccacaaccaccacucccacccauguucccacuaagaccacuaccaccaauacuaccagaccuacaccuagaagcauggccagcaacagacaaaacaaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7257 - RNA, 414 nt, Artificial Sequence; identical to SEQ ID NO: 6797
  mRNA product Design5 comprising derived and/or modified sequence from Homo sapiens__NP_001134.1__HsAMELY-TRAP (opt12)

SEQ ID NO: 7258 - RNA, 447 nt, Artificial Sequence
  mRNA product Design5 comprising derived and/or modified sequence from Homo sapiens__NP_001134.1__HsAMELY-LRAP (opt12)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaaugauaagaccaccaccaauacuaccagaccuacaccuagaagcauggccagcaacagacaaaacaaaacaagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7259 - RNA, 486 nt, Artificial Sequence; identical to SEQ ID NO: 6799
  mRNA product Design5 comprising derived and/or modified sequence from Homo sapiens__NP_001134.1__HLA-A2-SP_HsAMELY(17-61) (opt12)

SEQ ID NO: 7260 - RNA, 519 nt, Artificial Sequence; identical to SEQ ID NO: 6800
  mRNA product Design5 comprising derived and/or modified sequence from Homo sapiens__NP_001134.1__HLA-A2-SP_HsAMELY(17-48,169-192) (opt12)

SEQ ID NO: 7261 - RNA, 846 nt, Artificial Sequence
  mRNA product Design5 comprising derived and/or modified sequence from Sus scrofa__NP_999071.1__SsAMELX-001-1 (opt12)
gggagagucccgcagucggcguccagcggcucugcuuguucgugugugugucguugcaggccuuauucaagcuuaccaugggaaccuggauauuauucgcaugccuacuaggagcagcauucucaaugccacuaccaccacacccaggacacccaggauacauaaacuucuccuacgaaguauuaacaccacuaaaaugguaccaaaacaugauaagacaccccuacacaucauacggauacgaaccaaugggaggauggcuacaccaccaaauaauacccguaguaucacaacaaacaccacaaucacacgcacuacaaccccaccaccacauaccaaugguaccagcacaacaaccaggaauaccacaacaaccaaugaugccacuaccaggacaacacucaaugacaccaacacaacaccaucaaccaaaccuaccacuaccagcacaacaaccauuccaaccacaaccaguacaaccacaaccacaccaaccacuacaaccccaaucaccaaugcaccccauacaaccacuacuaccacaaccaccacuaccaccaauguucucaaugcaaucacuacuacccgaccuaccacuagaagcauggccagcaacagacaaaacaaaacgcgaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7262 - RNA, 414 nt, Artificial Sequence; identical to SEQ ID NO: 6802
  mRNA product Design5 comprising derived and/or modified sequence from Sus scrofa__NP_999071.1__SsAMELX-TRAP (opt12)

SEQ ID NO: 7263 - RNA, 447 nt, Artificial Sequence; identical to SEQ ID NO: 6803
  mRNA product Design5 comprising derived and/or modified sequence from Sus scrofa__NP_999071.1__SsAMELX-LRAP (opt12)

SEQ ID NO: 7264 - RNA, 486 nt, Artificial Sequence; identical to SEQ ID NO: 6804
  mRNA product Design5 comprising derived and/or modified sequence from Sus scrofa__NP_999071.1__HLA-A2-SP_SsAMEL(17-61) (opt12)

SEQ ID NO: 7265 - RNA, 519 nt, Artificial Sequence; identical to SEQ ID NO: 6805
  mRNA product Design5 comprising derived and/or modified sequence from Sus scrofa__NP_999071.1__HLA-A2-SP_SsAMEL(17-49,167-189) (opt12)

SEQ ID NO: 7266 - RNA, 810 nt, Artificial Sequence
  mRNA product Design5 comprising derived and/or modified sequence from Sus scrofa__P45561-2__SsAMELX-001-2 (opt12)
gggagagucccgcagucggcguccagcggcucugcuuguucgugugugugucguugcaggccuuauucaagcuuaccaugggaacauggauauuauucgcaugccuacuaggagcagccuucucaaugccacuaccaccacacccaggacacccaggauacauaaacuucucauacauaagacauccauacacaucauacggauaugaaccaaugggaggauggcuacaccaccaaauaauaccaguaguaucacaacaaaccccacaaucacacgcacuacaaccacaccaccacauaccaaugguaccagcacaacaaccaggaauaccacaacaaccaaugaugccauuaccaggacaacacuccaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccccaaccaccacuaccaccaauguucucaaugcaaucacuacuaccagaccuaccacuagaagcauggccagccacagacaaaacaaaacgagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7267 - RNA, 846 nt, Artificial Sequence
  mRNA product Design5 comprising derived and/or modified sequence from Sus scrofa__NP_998965.1__SsAMELX-001-3 (opt12)
gggagagucccgcagucggcguccagcggcucugcuuguucgugugugugucguugcaggccuuauucaagcuuaccaugggaacauggauauucuucgcaugcuuacuaggagcauccuuagcaaugccacuaccaccacacccaggccacccaggauacauaaacuucucauacgaaguacuaacaccacuaaaaugguaccaaaacaugauaagacacccauacacaucauacggcuacgaaccaaugggcggcuggcuacaccaccaaauuauaccaguaguaucacaacaaacaccacaaucacacgcacuacaaccccaccaccacauaccaaugguaccagcacaacaacccggaauaccacaacaaccaaugaugccacucccaggacaacacucaaugacaccaacacaacaccaccaaccaaaccucccacuaccagcacaacaaccauuccaaccccaaccaguacaaccacaaccacaccaaccacuacaaccacaaucaccuaugcacccaauacaaccauuacuaccccaaccaccacuaccaccaauguucucaaugcaaucacuacuaccagaccuaccacuagaagcauggccagcaacagacaaaacaaaaagagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7268 - RNA, 495 nt, Artificial Sequence; identical to SEQ ID NO: 6808
  mRNA product Design5 comprising derived and/or modified sequence from Sus scrofa__K7GPB2__SsAMELX-002 (opt12)

SEQ ID NO: 7269 - RNA, 888 nt, Artificial Sequence
  mRNA product Design5 comprising derived and/or modified sequence from Sus scrofa__K7GLD0__SsAMELX-003 (opt12)
gggagagucccgcagucggcguccagcggcucugcuuguucgugugugugucguugcaggccuuauucaagcuuaccaugggaacauggauacuauucgcaugccuacuaggcgcagcauucucaaugccacuaccaccacaccccggacacccaggcuacauaaacuucucauacgaagauuuauacuuagaagcaauaagaauagacagaacagcauuuguauuaacaccacuaaaaugguaccaaaacaugauaagacacccauacacaucauauggauacgaacccaugggaggauggcuacaccaccaaauaaucccaguaguaucacaacaaacaccacaaucacacgcccuacaaccacaccaccacauaccaaugguaccagcacaacaaccaggaauaccacaacaacccaugaugccacuaccaggacaacacucaaugacaccaacacaacaccaccaacccaaccuaccacuaccagcacaacaaccauuccaaccacaaccaguacaaccacaaccacaccaaccauuacaaccacaaucaccaaugcacccaauacaaccccuacuaccacaaccaccacuaccaccaauguucucaaugcaaucacuacuaccagaccuaccacuagaagccuggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7270 - RNA, 774 nt, Artificial Sequence
  mRNA product Design5 comprising derived and/or modified sequence from Sus scrofa__K7GPE9__SsAMELX-004 (opt12)
gggagagucccgcagucggcguccagcggcucugcuuguucgugugugugucguugcaggccuuauucaagcuuaccaugggaacauggauacuauucgcaugccuacuaggagcagcauucucaaugccacucccaccacacccaggacacccaggauacauaaacuucucauacgaaguacuaacaccacuaaaaugguaccaaaacaugauaagacacccaacaccacaaucacacgcacuccaaccacaccaccacauaccaaugguaccagcacaacaacccggaauaccacaacaaccaaugaugccacuaccaggacaacacuccaugacaccaacacaacaccaccaaccaaaccucccacuaccagcacaacaaccauuccaaccacaaccaguacaaccacaaccacaccaaccacuacaaccacaaucacccaugcacccaauacaaccacuacucccacaaccaccacuaccaccaauguucucaaugcaaucacuacuaccagaccucccacucgaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7271 - RNA, 798 nt, Artificial Sequence
  mRNA product Design5 comprising derived and/or modified sequence from Sus scrofa__J9JIM4__SsAMELX-201 (opt12)
gggagagucccgcagucggcguccagcggcucugcuuguucgugugugugucguugcaggccuuauucaagcuuaccaugccacucccaccacacccaggacacccaggauacauaaacuucucauacgaaguacucacaccccuaaaaugguaccaaaacaugauaagacaccccuacacaucauacggauacgaacccaugggaggauggcuacaccaccaaauaauaccaguagucucacaacaaacaccacaaucacacgcacuccaaccacaccaccacaucccaaugguaccagcacaacaaccaggaauaccacaacaaccaaugaugccacuaccaggacaacacucaaugacaccaacacaacaccaccaaccaaaccuaccacuacccgcccaacaaccauuccaaccccaaccaguacaaccacaaccacaccaaccacuccaaccacaaucaccaaugcacccaauacaaccacuacuaccacaaccaccacucccaccaauguucucaaugcaaucacuacucccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7272 - RNA, 3237 nt, Artificial Sequence
  mRNA product Design5 comprising derived and/or modified sequence from Homo sapiens__NP_006120.1__HsBMP1 (opt12)
gggagagucccgcagucggcguccagcggcucugcuuguucgugugugugucguugcaggccuuauucaagcuuaccaugccugggguugcaagacuaccguuacuauugggauuacuacuauuaccaaggccaggaagaccauuagauuuagcagauuauacguaugauuuagcagaagaagacgauagugaaccauuaaauuauaaagauccauguaaagcagccgcguuuuuaggggacauagcacuagaugaagaagaucuaagagcauuucaaguacaacaagcaguugaccuaagaagacacacagcuagaaaaucaucaauuaaagccgcugucccgggaaauacgaguacaccgaguugucaaucuacuaacggacagccacaacguggugcaugcggaagauggagaggacgcucaaggagucggagagcggcaacaagcagaccagaaagggucuggccagauggaguaauaccuuucguaauaggaggaaauuuuacaggaagucaaagagcaguauuccgucaagcuaugagacauugggaaaaacauaccuguguaacguuuuuagaaagaacagaugaagauaguuacauaguguuuacguaucgaccaugcggauguuguucuuacguaggaagacgagggggugguccccaagcaauaucaauagguaaaaacugcgauaaauucgggauaguaguacaugaacuagggcauguaguuggauuuuggcaugaacacacacgacccgauagagauagacaugucucaauaguaagggaaaacauacaacccggacaagaauauaauuucuuaaaaauggaaccacaagaaguugaaaguuuaggugaaacguaugacuucgauaguauuaugcauuaugcacgaaauaccuuuaguagaggaauuuuucuugacacuauaguaccgaaauaugaaguaaaugguguaaaaccaccaauaggucaaagaacaagauuaucaaaaggagauauagcacaagcucgaaaacuguacaaaugcccagcuuguggugaaacauugcaagauucaacaggaaauuucaguagcccagaauacccaaacggauauagugcgcauaugcauugcgucuggaggauuaguguaacaccaggugagaaaauaauacuaaauuuuacgaguuuagacuuauaucgaagcagauuauguugguaugacuauguugaaguuagagauggauuuuggagaaaagcaccauuaagaggaagauuuuguggaucaaaacuaccagaaccaauaguaaguacagauaguaggcuuuggguagaguucagaagcucgaguaauuggguaggcaaaggauucuuugcagucuaugaagccauauguggaggggauguuaagaaagacuauggacacauacaaucaccuaauuauccggacgauuaccgaccaagcaaaguuuguauuuggcggauucaaguaagcgaagguuuccacguaggacuuacauuccaaucuuuugaaauugaacgccaugauaguugcgcauacgacuaucuagaaguaagagauggucauagcgaaaguucaacacuaauuggaagauacugcggauaugaaaaaccugacgauauaaaaucaacaagcagucgauuauggcuaaaauuugugagugacggaagcauaaauaaagcuggcuucgcuguaaacuuuuucaaagaaguagaugaauguaguagaccaaauaggggcggaugugaacaacguuguuuaaauacuuuaggcucguauaaaugcagcugugaucccggauaugaacucgcaccagauaaaagaagaugugaagcagcauguggaggauuuuugacaaaacuuaaugguuccauaaccaguccaggguggccaaaagaauauccgccaaauaaaaauugcauuuggcagcuaguagcuccaacucaauaccguaucaguuuacaauucgacuucuuugaaacagaaggcaaugacguaugcaaauacgauuuuguagaaguuagaucugggcuaaccgcugacaguaaauuacauggaaaauuuuguggcucagaaaaaccagaaguaaucacaucacaauacaauaacaugagagucgaguuuaaaagcgauaacacaguuaguaagaaagguuuuaaagcccauuucuuuagugauaaagaugaaugcucaaaagauaauggagggugucaacaagauugcguaaauacauuuggaagcuacgaaugccaauguagauccggauuuguacuccaugauaauaaacacgauuguaaagaagcaggaugugaccacaaaguaaccucuacaucggggacuaucacgaguccaaacuggccagauaaauacccuucaaagaaagaaugcacuugggcgaucaguucuacuccaggacauaggguuaaauuaacauuuauggaaauggacauagaaucacaaccugaaugugcuuaugaccauuuagaaguuuuugauggaagagaugcuaaagcgccuguuuuaggucgguuuugcggaaguaaaaagccugaaccugucuuagccacuggcucaaggauguuuuuaagguuuuauucagacaacucaguccaaagaaaaggauuucaagcaagucaugcgacagaaugcggaggccaaguacgagcagauguaaaaacaaaagaucuuuauucucaugcacaauuuggugauaauaauuauccuggaggaguugauugugaguggguaauaguagcagaagaagguuauggaguugaauuaguauuucaaacguuugaaguagaagaagaaaccgauugcgguuaugacuacauggaacuauucgaugguuaugauucaacagcuccuagauuaggaagauauugugggucaggcccgccagaggaaguauauagugcaggagauagcguucuaguaaaauuucacagcgacgacacaauaaccaagaaaggauuccaucuacgcuauacaucaacuaaauuccaagauacacuacauagcagaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7273 - RNA, 1467 nt, Artificial Sequence
  mRNA product Design5 comprising derived and/or modified sequence from Homo sapiens__NP_001191.1__HsBMP2 (opt12)
gggagagucccgcagucggcguccagcggcucugcuuguucgugugugugucguugcaggccuuauucaagcuuaccauggucgcaggaacaagaugucuacuagcacuauuacuuccacaaguucuacuaggaggagcagcuggauuaguaccagaauuaggaagaagaaaauuugcggcagcaucaucuggaagacccaguucacaaccaucagacgaaguauuaucagaauuugaacuuagacuacuuagcauguucggauuaaaacaacgucccacaccaucuagagaugcaguaguaccacccuauaugcuugaccuauacagacgucacagcggccaaccaggaucaccagcaccagaccauagacuagaaagagccgcaucaagagcaaacacaguaagaucauuccaccaugaagaaagcuuagaagaauuaccagaaacaucagguaaaacuacaagaagguuuuucuuuaacuuaagcucuauaccaacagaagaauuuauaacaucagcagaauuacaaguauucagagaacaaaugcaagacgcacuaggcaauaauagcagcuuucaccacagaauaaauauauaugaaauuauaaaaccagcaacagcaaacucaaaauuuccaguaacaagacuauuagacacacgacuaguaaaucaaaaugcaucaagaugggaauccuucgacguaacaccagcaguaaugagauggacagcacaaggacacgcaaaccauggauuuguaguagaaguagcucacuuagaagaaaaacaaggaguaaguaaacgucauguaagaauuagcagaaguuuacaucaagacgaacauuccuggucucaaauuagaccacuacuaguaacauucggacaugacggaaaaggacacccacuacacaaaagagaaaaacgacaagcaaaacauaaacaacguaaaagauuaaaauccucauguaaaagacauccauuauacguagauuucucagacguaggauggaacgacuggauaguagcaccacccggauaccacgcuuucuauugccauggagaaugcccauucccacuugcagaccaucuaaacagcacaaaucacgccauuguacaaacauuaguaaacagcguaaacuccaaaauaccaaaagcaugcugcguuccaacagaauuaagcgcaauaucaauguuauacuuagacgaaaaugaaaaaguaguacuaaaaaauuaccaagacaugguaguagaaggcuguggaugccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7274 - RNA, 1503 nt, Artificial Sequence
  mRNA product Design5 comprising derived and/or modified sequence from Homo sapiens__NP_001193.2__HsBMP4 (opt12)
gggagagucccgcagucggcguccagcggcucugcuuguucgugugugugucguugcaggccuuauucaagcuuaccaugauaccaggaaauagaaugcuuaugguaguauuacuaugccaaguauuacuaggaggugcaucccaugccucauuaauaccagaaaccggcaaaaaaaaaguagcugaaauacaaggacaugcaggaggaagaagauccggacaaucacacgagcuacuaagagacuuugaagcuacauuauuacaaauguuuggauuacgaagaagaccacaaccuucaaaaucagcugucauuccagauuauaugagagacuuauauagauuacaaucuggugaagaagaagaagaacaaauccacucaacuggacuggaauauccagaaagaccagcuucaagagcuaauacuguucguucauuucaucacgaagaacauuuagaaaacauaccaggaacaagcgaaaauagugcauuuagauucuuauucaaccuauccagcauuccagaaaacgaaguaauaucaagugcagaauuaagauuauuucgugaacaaguagaucaaggaccagacugggaaagaggauuucacagaauuaacauauaugaaguuaugaaaccaccugcagaagucguaccaggucaccuaauaacaagauuauuagauacaagacuaguacaucauaacgucacaagaugggaaacuuuugacguaucaccagcaguauuacgauggacacgagaaaaacaaccaaauuacggucuagcaauagaaguaacacaccuacaucaaacaagaacccaccaaggacaacauguacgaauaucaagaucauuaccacaaggaagcggaaacugggcacaauuaagaccacuacuaguuacuuuuggacacgauggaagaggacacgcacuaacacggagaagaagagcaaaacguucaccaaaacaccauucucaaagagcaagaaaaaaaaauaaaaacugcagacgacauagcuuauauguagauuucucagauguaggguggaaugacuggauaguagcaccuccaggauaccaagcauuuuacugucacggugacuguccauuucccuuagccgaucacuuaaacucaacaaaucaugcaauaguacaaacacuaguaaacaguguaaacucaaguauaccuaaagcaugcugcguaccaacagaacuaucagcaauuucaauguuauaccuagacgaauaugacaaaguuguauuaaaaaauuaucaagaaaugguuguagaaggauguggauguagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7275 - RNA, 1818 nt, Artificial Sequence
  mRNA product Design5 comprising derived and/or modified sequence from Homo sapiens__NP_001709.1__HsBMP6 (opt12)
gggagagucccgcagucggcguccagcggcucugcuuguucgugugugugucguugcaggccuuauucaagcuuaccaugccaggacuagguagaagggcccaauggcuauguuggugguggggucuauuauguucauguuguggacccccuccucuaagaccaccauuaccagcugcugcagcagcagcagccggcgggcaauuacuaggagauggaggcucgccaggaagaacagaacaaccaccaccaucaccacaaucaucaucagguuuccuauacagacgacuuaaaacacaagaaaaacgagaaaugcaaaaagaaauauuaucuguuuuaggucuaccacauagaccuagaccacuacauggccuacaacaaccucaaccuccagcccuucgccaacaagaagaacaacaacaacaacaacaauuaccaagaggugagccaccacccgguagauuaaaaucagcuccuuuauucauguuagauuuauacaacgcccuauccgccgauaaugaugaagauggagcaucagaaggcgagaggcaacaaucauggccgcaugaagcagcuucaucaucacaacgccgacaaccaccuccuggugcugcacauccauuaaaucguaaaagccuacuugcaccaggaucaggaucuggaggagccucaccacuaacaagcgcacaagauucagcauuucuaaaugacgcugauauggucaugaguuuuguaaaucuaguagaauacgauaaagaguucucuccaagacaaagacaucauaaagaauuuaaauuuaaucuaucucaaaucccagaaggagaaguaguaacagcggcagaauuuagaauauauaaagauuguguaaugggaucauucaaaaaucaaacuuuucuaauuucaauauaccaaguauuacaagaacaucaacaucgcgacucagaccucuuuuuacucgacacccgaguuguuugggcauccgaagaaggcuggcuagaauuugauauuacagcaacaucaaauuuauggguaguaaccccucaacauaacauggguuuacaauuaaguguaguaacaagagacggaguucacguccacccaagagcugcaggauuaguaggaagagauggaccauaugacaaacaaccauucaugguugcauucuuuaaaguuagugaaguucauguacgaacaacaagaucagcaaguucaagaagaagacaacaaucuagaaaccgaaguacacaaucacaagauguugcacgaguaucaucugccagugacuauaauucaucagaauuaaaaacagcauguagaaaacacgaauuauacguaucauuucaagauuuagguuggcaagacuggauaauagcaccaaaaggauacgcagcaaauuauugugacggcgaauguucauuuccuuuaaaugcacauaugaaugcaacaaaccaugcaauaguccaaacauuaguccacuuaaugaauccagaauacguaccaaaaccuuguugugccccaacaaaauuaaaugcaaucucaguacuauacuucgaugauaauucaaauguaauauuaaagaaauaccgaaauaugguaguaagagcuugcggcugucacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7276 - RNA, 1572 nt, Artificial Sequence
  mRNA product Design5 comprising derived and/or modified sequence from Homo sapiens__NP_001710.1__HsBMP7 (opt12)
gggagagucccgcagucggcguccagcggcucugcuuguucgugugugugucguugcaggccuuauucaagcuuaccaugcaugucagaucacuuagagcagcagccccacauucuuucguagcauuaugggcaccauuauucuuauuaagaagcgcacuagcagacuuuucauuagacaaugaaguacauaguagcuuuauacauagacgccuaagaucacaagaaagacgagaaaugcaaagagaaauccuaucaauauuaggauuaccacauagaccaagaccucaucuacaaggaaaacacaacuccgcuccaauguucauguuagaccuauauaacgcaauggcugucgaagaaggaggagguccaggaggacaagguuuuaguuaucccuacaaagcaguauuuagcacacaaggcccaccacucgcaagcuuacaagauucccauuuccuaacagaugccgauaugguuaugaguuucguuaaucuuguagaacacgauaaagaauucuuccacccuagauaucaccaucgagaguucagauucgaucuuucaaaaauaccagaaggagaagccguuaccgcagcagaauuuagaauauauaaagauuacauccgcgaacgauuugacaaugaaacauucagaauaucaguauaucaaguacuacaagaacaucuagggagagaaucagaucuauuuuuauuagacucuagaacacuaugggcaucagaagaaggaugguuaguuuucgauauaacagccacaagcaaucacuggguaguaaacccuagacacaacuuaggauuacaauuaagcguagaaacacucgacggccaaaguauaaaccccaaacuagcaggacuaauaggacgacacggcccacaaaacaaacaaccauuuauggucgccuuuuucaaagcuacagaaguacauuuccgaucaauacgaucuacaggauccaaacaaagaucacaaaacagaucuaaaacaccaaaaaaucaagaagcauuaagaauggccaauguagcagaaaauagcucaucagaucaacgacaagcaugcaaaaaacaugaacuauacgugaguuucagagaucucggauggcaagauuggauaauagcaccagaaggauaugcagccuauuauugugaaggugaaugugcauuuccacuaaauucuuacaugaaugcaaccaaucacgcaauaguucaaacacuaguacacuuuauaaacccagaaacaguaccaaaaccuuguugcgcaccaacacaauuaaacgcaaucucaguauuauacuucgaugauaguucuaacguaauauuaaaaaaauacagaaacaugguagucagagcaugcgguugucacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7277 - RNA, 576 nt, Artificial Sequence; identical to SEQ ID NO: 6817
  mRNA product Design5 comprising derived and/or modified sequence from Homo sapiens__NP_006264.2__HsCCL7 (opt12)

SEQ ID NO: 7278 - RNA, 3900 nt, Artificial Sequence
  mRNA product Design5 comprising derived and/or modified sequence from Homo sapiens__NP_001954.2__HsEGF (opt12)
gggagagucccgcagucggcguccagcggcucugcuuguucgugugugugucguugcaggccuuauucaagcuuaccaugcuacucacguugauaauauuauuaccaguaguaucaaaauucucuuuuguuagccuaagugccccacaacauuggucuuguccagaagggacguuagccgggaauggaaacaguacaugugugggaccugccccauuuuuaauauuuucacacggaaauuccaucuuuagaaucgauacugaagggacaaauuaugaacaauuaguuguagaugccgguguaucaguaaucauggacuuccauuauaaugaaaaacggauuuacuggguugaucucgaaagacaacuacuucaaagaguguuuuuaaaugggaguaggcaagaaagagucuguaauauugagaaaaauguaucaggaauggcuauaaauuggauaaacgaagagguaauauggucuaaucaacaagaagguauuauaacugugacugauaugaaaggaaauaacucacauauccuccuaucugcucuaaaauauccugcuaacguggcaguugauccagucgaacgauuuaucuuuuggucaucagaggucgcaggaucgcuauauagagcagacuuagaugguguaggaguaaaagcauuacuagaaaccagcgagaaaauaacugcaguaaguuuagauguacucgacaaaagauuauucuggauacaauacaauagagaaggaucaaauucacuaauauguucuugugacuaugauggcggaagcguccacauaucuaaacaccccacacaacauaauuuauuugcgaugaguuuauuuggugauagaauauuuuauaguacguggaaaaugaaaaccauauggauagcuaauaaacauacaggaaaagacaugguccgaauaaaccuacacucauccuuuguaccucuaggggaauugaaaguaguacauccacuagcacaaccaaaagcggaagacgacacaugggaaccggaacaaaaacucuguaaacucagaaaggguaauuguucgaguacuguauguggacaagaucuacaaagccauuuauguaugugcgcagaaggauaugcuuuaucaagagaucgaaaauauugcgaagaugucaaugagugugcauuuuggaaucauggauguacccuuggcugcaaaaauaccccaggcucauauuauugcacuuguccaguaggauuuguauuguuaccugauggaaagcgaugucaucaacuuguaaguuguccacgaaauguuagugaauguucacaugauugcguguuaacaucagaaggcccauuaugcuucugcccagaaggaucaguguuagaaagagauggcaaaacuugcaguggaugcaguagcccagacaaugguggauguagucaauuauguguuccguuauccccagugucgugggaaugugacuguuuuccaggauaugauuuacagcuagacgaaaaaucuugcgcagcaagcgguccacaacccuuuuuacuauuugcaaauucccaagacauucgucacaugcauuuugaugguacugauuaugguacauuauuaucacaacaaauggguaugguauaugcauuagaccaugauccugucgaaaacaaaauauauuucgcucauacagccuuaaaguggaucgaacgcgcuaacauggauggaagucaaagagaaaggcucauugaagaaggagucgauguacccgaaggcuuagcaguagacuggauaggccgccgauuuuauuggacagauagagguaaaagucuuauaggacguucagacuuaaauggaaaaagaaguaaaauuauaacaaaagaaaacauaucacaaccuaggggaauagcaguacauccaauggcaaaacgccucuuuuggacagauacaggcauaaauccuagaauugaaaguucuagcuuacagggacuaggccggcuaguaauugccucaucagaccuaauauggccaagugggauaaccauagauuuucucacggacaaauuguauuggugcgaugcaaaacagucaguaauagaaauggcuaaucucgaugguucaaagagaaggagauuaacacagaacgauguuggucacccauucgcaguagcaguauucgaggauuacgucugguuuucggauugggcaaugccaaguguaaugagaguaaacaaaagaacagguaaagauagaguacgauuacaaggauccauguuaaagcccuccucauuaguagucguucauccauuggcuaaaccaggagccgacccaugcuuauaccaaaauggugguugugaacacauuuguaagaaaagauuaggaacagccugguguucaugcagagaaggcuucaugaaagcaucagauggaaaaacaugccuagcauuagauggacaccaacuacuagcaggaggagaaguugaccucaaaaaccaaguaacgcccuuagauauauuaaguaaaacucgaguuagugaggacaacauaacagaaagucaacacauguuaguggcugaaauaaugguaagugaucaagacgauugugcaccaguaggauguucaauguaugcacgcuguaucucagaaggcgaagaugcaacuugccaaugccuaaaaggcuucgcgggcgauggaaaacuauguucagacauagaugaaugugaaauggguguuccuguaugucccccagcguccucaaaaugcauaaauaccgaaggcggcuauguaugucguuguucagaaggguaccaaggugauggaauccauuguuuagauauagacgaaugucaauuaggcgaacauaguuguggugagaacgcuucuugcaccaacacagaaggagguuacacauguaugugcgcagggaggcuaagugagccaggauuaauuuguccagauaguacaccaccuccccaccuaagagaggaugaucaucauuacucaguaagaaauucagauagugaauguccauuaucucacgaugguuacugccuacaugacgguguaugcauguauauagaagccuuagauaaauaugcuuguaacuguguagucggcuacauaggagaaaggugucaauauagggaccuaaaauggugggaauuacgacaugcuggccaugggcaacaacaaaaaguaauaguuguagcagucugugucguaguucuaguaaugcuccucuuacuaucccuauggggugcucauuauuaccgaacgcaaaaacuucugaguaaaaauccuaaaaauccauacgaagaaucaucaagagauguacgaucaaggagaccagccgauacagaagaugggaugucgucuugcccacagccaugguucguuguaauaaaagaacaccaagauuugaaaaacggaggucaaccugucgcaggagaggauggacaagcugcagaugguaguaugcaacccacaaguuggagacaagaaccccaauuaugcggaaugggaacggaacaagggugcuggauuccaguaucgagcgacaaagggucuugcccccaaguaauggaaagaucguuccauaugcccucauacggaacgcaaacuuuagaaggaggaguagagaaaccacauuccuuacuaagcgcaaauccauuauggcaacaacgagcuuuagauccaccacaucaaauggaauugacacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7279 - RNA, 786 nt, Artificial Sequence
  mRNA product Design5 comprising derived and/or modified sequence from Homo sapiens__NP_001423.1__HsEREG (opt12)
gggagagucccgcagucggcguccagcggcucugcuuguucgugugugugucguugcaggccuuauucaagcuuaccaugacagcaggaagaagaauggaaaugcuaugugcaggaagaguaccagcacuauuacuaugucuaggauuccaucuauuacaagcaguauuaaguacaacaguaauaccaagcuguauaccaggagaaagcucagacaauugcacagcauuaguacaaacagaagacaauccaagaguagcacaaguaagcauaacaaaaugcucaagugauaugaauggauauugcuuacacggacaauguauauaucuaguagacaugagccaaaacuauugcagaugcgaaguaggauacacgggaguaagaugugaacacuucuuucuaacaguacaucaaccacuaucaaaagaauacguagcauuaacaguaauauuaauaauacuauuucuaauaacaguaguaggaagcacauacuauuucuguagaugguacagaaacagaaaaucaaaagaaccaaaaaaagaauaugaaagaguaacaucaggagauccagaacuaccacaaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7280 - RNA, 744 nt, Artificial Sequence
  mRNA product Design5 comprising derived and/or modified sequence from Homo sapiens__NP_000791.1__HsFGF1 (opt12)
gggagagucccgcagucggcguccagcggcucugcuuguucgugugugugucguugcaggccuuauucaagcuuaccauggcagaaggagaaauaacaacauucacagcacuaacagaaaaauucaaccuaccaccaggaaacuacaaaaaaccaaaacuacuauacugcucaaacggaggacacuucuuaagaauacuaccagacggaaccguagacggaacaagagacagaucagaccaacacauacaacuacaauuaucagcagaaucaguaggagaaguauacauaaaauccacagaaacaggacaauacuuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaucaugcaaaagaggaccaagaacacacuacggacaaaaagcaauacuauuccuaccccuaccaguauccucagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7281 - RNA, 1143 nt, Artificial Sequence
  mRNA product Design5 comprising derived and/or modified sequence from Homo sapiens__NP_001997.5__HsFGF2 (opt12)
gggagagucccgcagucggcguccagcggcucugcuuguucgugugugugucguugcaggccuuauucaagcuuaccaugguaggggugggaggaggagacguagaagacguaacaccaagaccaggaggaugucaaauaaguggaagaggagcaagagguuguaauggaauaccaggagcggcagcaugggaagcagcauuaccgagaagaagaccgagaagacacccaaguguaaauccuagaucaagagcagcuggaagcccaagaacacgaggaagaagaacagaagaaaggccuaguggaaguagauuaggggacagaggaagaggaagagcauugccaggaggaagacuaggcggaagaggaagaggaagagcaccagaaagaguaggagguagaggaagaggaagaggaacagcagcaccaagagcagcaccagcagcaaggggaaguagaccaggaccagcgggaacaauggcagcaggaaguauaacaacacuuccagcauugccagaagauggaggaaguggcgcauuuccgccaggacauuuuaaagauccaaagagauuauacuguaaaaauggagguuuuuuuuuaagaauacauccagauggaagaguagauggaguaagagaaaaaagugauccacauauaaaauuacaauuacaagcagaagaaagaggaguaguaaguauaaaaggaguaugugcaaacagauauuuagcaaugaaagaagauggaagauuacuagcaaguaaauguguaacagaugaauguuuuuucuuugaaagauuagaaaguaauaauuauaauacguaccgaaguagaaaauauacaaguugguauguagcguuaaaaagaacaggacaauauaaauuaggaagcaaaacaggaccgggacaaaaagcaauauuauuuuuaccuaugagugcgaaaaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7282 - RNA, 861 nt, Artificial Sequence
  mRNA product Design5 comprising derived and/or modified sequence from Homo sapiens__NP_002000.1__HsFGF7 (opt12)
gggagagucccgcagucggcguccagcggcucugcuuguucgugugugugucguugcaggccuuauucaagcuuaccaugcacaaauggauacuaacauggauacuaccaacacuacuauacagaagcugcuuccacauaauaugcuuaguaggaacaauaagccuagcauguaacgauaugacaccagaacaaauggcaacaaauguaaacugcagcucacccgaaagacacacaagaucauacgacuacauggaaggcggagacauaagaguaagaagacuauucugcagaacacaaugguacuuacgaauagacaaaagaggaaaaguaaaaggaacacaagaaaugaaaaacaacuacaacauaauggaaauaagaacaguagcaguaggaauaguagcaauaaaaggaguagaaucagaauucuaccuagcaaugaacaaagaaggaaaacuauacgcaaaaaaagaaugcaacgaagacugcaacuucaaagaauuaauacuagaaaaccacuauaacacauacgcaagcgcaaaauggacacacaacggaggagaaauguucgucgcacuaaaccaaaaaggaauaccaguaagaggaaaaaaaacaaaaaaagaacaaaaaacagcacacuuccuaccaauggcaauaacauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7283 - RNA, 903 nt, Artificial Sequence
  mRNA product Design5 comprising derived and/or modified sequence from Homo sapiens__NP_001936.1__HsHBEGF (opt12)
gggagagucccgcagucggcguccagcggcucugcuuguucgugugugugucguugcaggccuuauucaagcuuaccaugaaacuacuaccaagcguaguacuaaaacuauucuuagcagcaguacuaagcgcacuaguaacaggagaaagccucgaaagacuacgaagaggccuagccgcagguacaucaaacccagacccaccaacaguaucaacagaccaauuacuaccacuaggaggaggaagagacagaaaaguaagagaccuucaagaagcagaccuagaucuacuaagaguuacauuaucaucaaaaccacaagcacuagcaacaccaaacaaagaagaacacggaaaaagaaaaaaaaaaggaaaaggacuaggcaaaaaaagagacccaugcuuaagaaaauacaaagacuucugcauacacggagaaugcaaauacguaaaagaacuaagagcaccaucaugcauaugccacccaggauaucacggagaaagaugccacggauuaagccuaccaguagaaaauagacuauacacauacgaccacacaacaauacuagcaguaguagcaguaguacuaucaucaguaugucuacuaguaauaguaggacuauuaauguucagauaccacagaagaggcggauacgacguagaaaacgaagaaaaaguaaaacuaggaaugacaaauucacacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7284 - RNA, 2463 nt, Artificial Sequence
  mRNA product Design5 comprising derived and/or modified sequence from Homo sapiens__NP_000592.3__HsHGF (opt12)
gggagagucccgcagucggcguccagcggcucugcuuguucgugugugugucguugcaggccuuauucaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7285 - RNA, 2202 nt, Artificial Sequence
  mRNA product Design5 comprising derived and/or modified sequence from Homo sapiens__NP_005336.3 __HsHSPA1A (opt12)
gggagagucccgcagucggcguccagcggcucugcuuguucgugugugugucguugcaggccuuauucaagcuuaccauggcaaaagcagcagccauaggaauagaucuugguacaacauauucaugcguaggcguauuucaacauggaaaaguagaaauaauagcaaacgaccaaggcaaccgaacaacaccauccuacguggcuuucacagacacagaaagacuaauuggcgaugcagcuaaaaaucaaguugcauuaaauccacaaaacacaguauuugacgcaaaaagacucauaggaagaaaauuuggggauccuguaguccaaagcgauaugaaacacuggcccuuucaaguaauaaacgacggcgacaaaccaaagguacagguaaguuauaagggagaaacaaaagcauuuuaccccgaagaaaucagcagcaugguauuaacuaaaaugaaagaaauagccgaggcauauuuaggauauccaguuacaaacgcagucauaacuguaccagcauacuuuaaugauucacaaaggcaagcaacaaaagaugcaggaguaauagcuggauuaaacguauuaagaauaauaaacgaaccaacagcagcagcaauagcguaugguuuagaccgaacaggcaaaggagagagaaacguacuaaucuuugaucuaggaggaggaacauucgauguaucaauauuaacaaucgaugacggaauauucgaaguuaaagcaacugcaggagacacacacuuaggaggagaagauuuugauaacagauuaguaaaccacuuuguagaagaauuuaaacgaaaacauaagaaagacauuucacaaaauaaaagggcuguaagaagacuaagaacagcuugcgaaagagcuaaaagaacacuaagcagcucaacacaagcaagucuagaaauagacaguuuauuugaaggaaucgauuucuacacaucaauaacaagagcacgauuugaagaacuauguagugaccuauuuagaagcacucuagagccugucgaaaaagcauuaagagaugcuaaauuagacaaagcacaaauacacgaucuaguucuaguaggaggaucaacucgaauccccaaaguacaaaaacuauuacaagauuucuucaaugguagagaccucaauaaaaguauuaauccagaugaagcagucgcauauggugcugcaguacaggccgcaauuuuaaugggggauaaauccgaaaacguccaagaucuauuauuauuagacguagcaccauuaucacuagguuuagaaacagcuggagggguaaugacugcauuaauaaaaaggaacaguacaauaccgacaaaacaaacacaaauauuuacaacauacucagauaaucaaccaggaguuuuaauucaaguauacgagggagaacgcgcaaugacaaaagacaacaaucucuuaggccgguuugaacuaucagguauaccuccagccccuagagguguuccacaaauagaaguaacauuugauauugacgcuaaugguauccuaaacgucacagcaacugacaaaucaaccggaaaagcaaauaaaaucacaauaacaaaugauaagggaagacuuaguaaagaagaaaucgaaagaaugguacaagaggcagaaaaauauaaagcggaagacgaaguacaaagagaaagaguaagugcuaaaaacgcgcuugaauccuaugcauucaauaugaaaucagcagucgaggacgaaggauuaaaaggaaaaauaagugaagcagacaaaaagaaaguuuuagauaaaugccaagaaguuauuucaugguuagaugcaaauacauuagcagaaaaagacgaguucgaacauaaaaggaaagaacuagaacaaguauguaauccuauaauaagcggauuauaccaaggugcgggagguccaggacccggugguuucggugcucaaggaccuaaaggcggcaguggaaguggaccaacuauagaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7286 - RNA, 2202 nt, Artificial Sequence
  mRNA product Design5 comprising derived and/or modified sequence from Homo sapiens__NP_005337.2 __HsHSPA1B (opt12)
gggagagucccgcagucggcguccagcggcucugcuuguucgugugugugucguugcaggccuuauucaagcuuaccauggcuaaagcagcagcaaucggaaucgauuuagggacaacauacagcuguguaggaguauuccaacacggaaaaguugaaauaauagcaaaugaucagggaaacaggacaacuccuagcuauguugcauuuaccgauaccgaacgucucauuggagaugcggcaaaaaaucagguagcauuaaacccccaaaacacaguauuugacgcuaaaagauuaauaggacgaaaauucggagauccgguuguacaaagcgacaugaaacacuggccauuucaaguaauaaaugauggagacaaaccaaaaguccaagucucuuacaaaggagaaacaaaagcauucuacccagaagaaauaucaaguauggucuuaaccaaaaugaaagaaauagcagaagcauacuuaggguacccaguaacaaaugcaguaauaacaguucccgcauauuuuaacgauagccaaagacaagcuacuaaagacgcaggaguaaucgcaggauuaaauguacuuagaauuauaaaugagccaacugcagcagcaauugcauauggauuggacaggacuggaaaaggagaaagaaacguauuaauauuugaccuaggaggaggcacauuugacguaucaauauuaaccauagacgacggaauauucgagguaaaagcaacagcaggagacacccauuuaggaggagaagauuucgauaaucgauuaguaaaucauuuuguagaagaauuuaaaagaaaacauaaaaaagauauaucacaaaauaaaagagcaguuagacgauuacgaacagcuugcgaaagagcaaaaagaacccuaaguucuagcacacaagcuagccuugaaauugauucccuauuugaaggcauagauuucuauacaagcaucacucgagcaagauuugaagaauuaugcagugacuuauuuagaucaacucuagaaccuguagaaaaagcgcuuagagacgccaaauuagauaaagcacaaauccaugauuuagucuuaguaggaggaucaaccagaauacccaaaguacaaaaacuauuacaagacuucuucaacggaagagaucuaaauaaaucaauaaauccugacgaggcaguugccuacggagccgcgguacaagcagcaauacuaaugggagacaaaagcgaaaacguacaagaucuauuacuucuagauguagcaccucuaaguuuaggauuagaaacagcaggaggaguaaugaccgcacuaauaaaaaggaauucaacgauaccaacaaaacaaacucaaauuuucacaacauacucagacaaucaaccuggaguacuaauacaaguauacgaaggagagagagcaaugacaaaagauaacaaucuauugggaagauucgaacuaucaggaauacccccggcgccacgaggaguaccgcaaauugaaguaacuuuugauauagaugccaauggaauauuaaauguaaccgcaaccgauaaaagcacuggaaaagcaaauaaaauaacaauaacaaaugacaaaggaagacuaucaaaagaagaaauagaacgaaugguccaagaagcagaaaaauacaaagcagaagacgaaguacaacgagaacgaguuucagccaaaaaugcauuagaaucauacgcauuuaacaugaaaagugcaguagaagacgaaggacuaaaaggaaaaaucucagaagcagauaaaaaaaaaguacuggauaaaugucaagaagucauaaguugguuagacgcaaauacauuagcagaaaaagacgaauucgaacacaaaagaaaagagcuagaacaagucuguaacccuauaauaaguggacuauaccaaggagcgggaggaccaggaccaggagguuuuggugcacaagguccaaaaggcggaagcggcagcggaccuacaauagaagaaguagauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7287 - RNA, 2202 nt, Artificial Sequence
  mRNA product Design5 comprising derived and/or modified sequence from Homo sapiens__NP_005518.3 __HsHSPA1L (opt12)
gggagagucccgcagucggcguccagcggcucugcuuguucgugugugugucguugcaggccuuauucaagcuuaccauggcuacagcaaaaggaauagcuauuggaauagaucuaggcacaacauacaguugcguuggcguuuuucagcauggaaaaguagaaauuauagcaaaugaucaaggaaaucgcaccacuccuucuuauguagcuuucacagauacagaacgacuuauaggagacgcugcuaaaaaccaaguugcaaugaacccacaaaauacugucuuugacgcaaaaagacuaauaggccgaaaauucaaugacccaguaguacaagcggacaugaaacuuuggccauuccaagugaucaacgaaggugguaaaccaaaaguauuaguaucauacaaaggagaaaauaaagcauuuuacccagaagaaauaagcucuaugguacugacuaaauuaaaagaaacagcagaagcauuucuaggacacccaguaacaaaugcaguaauaacaguacccgcuuacuuuaaugacucccaaagacaagcaacaaaggacgcaggaguuauagcaggacuuaauguacuuagaauaaucaacgaaccaacagcggcagcaauagccuauggauuagauaaaggaggacaaggagaacgacauguauuaauauuugaccuagguggagguacauucgaugucucuauauuaaccauagacgacggaauauucgaaguaaaagcaacagcaggggacacucauuuaggcggagaagauuuugacaauagauuaguaagccacuucguagaagaguucaaaagaaaacacaaaaaggauauaagucagaauaaacgagcaguaagaagacuacgaacagccugugaaagagcuaaaagaacguuaucaaguucaacacaagcaaaucuagaaauagacagucuauaugaaggaauagauuucuauaccucaauaacgagagcuagauuugaagaacuaugcgcagaucuauucagaggcacacuagaaccaguagaaaaagcucuacgagaugcaaaaauggacaaagcuaaaauucaugauauaguccuuguagggggaucaacaagaauaccaaaaguacaaagauuguuacaagauuacuuuaacggaagagauuuaaacaaaucaauaaacccagaugaagcuguagcauauggcgcagcaguacaagcagcaauacuuaugggagauaaaagugaaaaaguacaagauuuauuauuauuagacguagcaccacuaucccuaggacuagaaacagcaggaggaguaaugacagcacucauaaaaagaaauaguaccauaccaacaaaacaaacccaaauauuuacaacguauagcgacaaucaaccaggaguacuaauacaaguguaugaaggagaaagagcaaugaccaaagauaauaaucuucuuggccgauucgaucucacaggaauaccuccagcaccaagaggagucccacaaauugaaguuacauuugacauagacgccaaugguauacuaaacguaacagcuaccgauaaaaguacaggaaaaguaaacaaaaucacaaucacaaaugacaaagguagauuaucaaaagaggaaaucgaaagaaugguauuggacgcagaaaaauauaaagcagaagacgaaguacaaagagagaaaauagcagcuaaaaacgcucuugaaucauaugcauuuaacaugaaaucaguaguauccgacgaaggacucaaaggaaaaauaagcgaaucagauaaaaauaaaauacucgauaaaugcaacgaacuauuaagcugguuagaaguaaaucaacuagcagaaaaagaugaauuugaccauaaaagaaaagaacuagaacaaauguguaauccaauaauaacuaaauuauaccaaggaggaugcacaggaccagccuguggcacaggauauguuccuggacgacccgcaacuggaccaacaauagaagaaguugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7288 - RNA, 2196 nt, Artificial Sequence
  mRNA product Design5 comprising derived and/or modified sequence from Homo sapiens__NP_068814.2 __HsHSPA2 (opt12)
gggagagucccgcagucggcguccagcggcucugcuuguucgugugugugucguugcaggccuuauucaagcuuaccaugagcgcaagaggaccagcgauuggaaucgaucuaggaacaacguacaguugcgugggaguauuccaacauggaaaaguugaaauaaucgcaaaugaucagggaaauagaacuacaccaucauacguugcuuuuacagacaccgaaagauugauuggagacgcagcgaaaaaucaaguagcaaugaauccaaccaacacaaucuuugacgcaaaaagacucauaggcagaaaauucgaagacgcaacgguacagagcgauaugaaacacuggccauuuagaguaguaucagaaggaggaaaaccaaaaguacaagucgaauauaaaggagaaacuaaaacauuuuucccagaagaaauaagcaguaugguauuaacaaaaaugaaagaaauagcagaagcauaucuaggaggaaaaguucauagugcaguaauaacuguaccagcauauuuuaaugauucacaaagacaagccacgaaagaugccggaacaauaaccggauuaaauguacugagaauaauaaacgaaccaacagcugccgcaauagcauacgggcuagauaagaaaggaugugccggaggugagaaaaauguauuaauauuugacuuaggcggaggaacauuugauguaucaauacuaacaauugaagacggaauauucgaaguuaaaaguacggcgggagauacacauuuaggaggagaagauuuugauaacagaaugguaagucauuuagcagaagaguucaaacgaaaacacaagaaagacauaggaccuaauaaaagagcaguaagaagacuaaggacugcaugcgaaagagcaaaaagaacacuaaguagcaguacacaggcgaguauagaaauagacucauuauaugaaggagucgauuuuuauacuucaauaacgagagcaagauucgaagaacucaaugcggauuuauuuagaggaacauuggaaccaguagaaaaagcacuuagagaugcaaaacuagacaaaggacaaauccaagaaauaguccuaguagguggcucaacaagaauaccaaaaauccaaaaacuauugcaagauuucuucaauggcaaagaauuaaauaagucaaucaauccagacgaagcagucgcauacggagcagcaguucaagcagcaauauugauaggggauaaaucagaaaauguacaagaccuauuauuguuagauguaacaccauuaagucucgguauagaaacugcaggaggaguaaugacaccucuaauaaaaagaaacacaacuauaccaacaaaacaaacacaaacauuuacaacauacagugacaaucaaucaaguguauuaguacaaguauacgaaggagaaagagcaaugacgaaagacaacaaucuauuaggaaaauuugaucuaacagggauuccuccagcaccgagagguguaccacaaaucgaaguaacauuugacauagacgcaaauggaauauuaaacguaacagcagcagauaaaucaaccgggaaagaaaacaaaaucacaauaacuaacgauaaagggagguuaagcaaagaugauaucgaucguaugguccaagaagcagaaagauauaaaagcgaggaugaggcaaacagagacagaguagcagcgaaaaaugcauuagaaucuuacacguauaauauaaaacaaacuguagaggacgaaaaauuacggggaaaaauauccgaacaagauaaaaacaaaauauuagauaaaugccaagaagucauaaacugguuagacagaaaucaaauggcagaaaaagaugaauacgaacauaaacagaaagaacuagaaagaguguguaaucccauaauaucaaaauuauaccaaggagguccaggagguggaagcgggggaggaggaaguggcgcaagcggagggccaacaauagaagaaguagauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7289 - RNA, 2799 nt, Artificial Sequence
  mRNA product Design5 comprising derived and/or modified sequence from Homo sapiens__NP_002145.3 __HsHSPA4 (opt12)
gggagagucccgcagucggcguccagcggcucugcuuguucgugugugugucguugcaggccuuauucaagcuuaccaugucuguaguaggaauagaccucggauuucaaaguuguuauguagcagucgcucgggcaggaggcauugaaacaauugcaaaugaauacucagacagguguacaccagcaugcauaaguuucggaccaaaaaaccgaucaauaggcgcagcagcaaaaagccagguaauaucaaaugcuaaaaauacaguacaaggguuuaaaagauuccacggaagagcauuuucagauccuuuuguagaagcugaaaaaaguaauuuagccuacgacauaguucaguuaccaacaggauuaacaggcauaaaaguaacuuauauggaagaagaacgaaacuuuacaacugaacaaguaacagcaaugcuacuaucuaaauuaaaagaaacugcagaaaguguuuuaaaaaaaccaguaguagacuguguaguaagcgugccauguuuuuauacagacgcggaaagaagaucggucauggaugcaacacaaauagcagggcucaauugccuuaggcucaugaaugaaacaacugcaguagcucuagcuuacggaauuuauaaacaagacuugccagcacuagaagagaaaccaagaaacgucguuuucgucgauaugggacacucagcauaccaaguaaguguuugcgcauuuaauagaggaaaacuaaaaguauuggcaacagcauuugacacaacacuaggagguagaaaauucgaugaaguacuagucaaucacuuuugugaagaauucggaaaaaaguacaaacuagauauuaaaucaaaaauuagagcauuauugcgacuaagccaagaaugugaaaaacuaaaaaaauuaaugucagcaaaugcaucugacuuaccauuaagcauugaaugcuuuaugaaugauguagaugucucaggaacaaugaaucgaggaaaauucuuagaaauguguaacgaucuacuagcuagagucgaacccccucucaggucagugcuagaacaaacaaaacuaaaaaaagaagauauauacgccguggaaaucguagguggagcuaccagaauaccagcugugaaagagaaaauaaguaaauucuucggcaaagaauuaucaacaacacuaaaugcagacgaagcaguuacccgaggaugugcuuuacaaugugcaauuuuaucgccagcauucaaaguacgagaauucucaauaacagauguaguaccuuaucccauaucucuuagauggaauucaccagcagaagagggaagcucagauugcgaaguauuuucaaaaaaccacgcugcaccguuuuccaaaguacugacuuucuacagaaaagaaccauuuacguuagaagcauacuauucaucuccccaagacuuaccauacccagaucccgccauugcacaauucucaguacaaaaggugaccccacaauccgacggauccagcucaaaagugaaaguaaagguaagaguaaauguacacggcauauuuucaguaaguucagcgucccucguagaaguucacaaaagcgaagaaaacgaagaaccaauggaaacagaccaaaacgcaaaagaagaagaaaaaaugcaaguagaccaagaagaaccccauguagaagaacaacaacaacaaacacccgcagaaaacaaagccgaaagugaagaaauggaaacaucacaagcaggcaguaaagauaagaaaauggaucaaccaccacaggcaaaaaaagcuaaaguaaaaacaaguacaguagaucucccaauugaaaaucaacuacuauggcaaaucgauagagagauguuaaaccuauacaucgaaaaugaaggaaaaaugaucaugcaagacaaacuagaaaaagaacggaacgaugcaaaaaacgcaguggaagaguauguauaugaaaugcgagacaaacuaucaggagaauaugaaaaauuuguuagcgaggaugacagaaauucauucaccuuaaaacuagaagauacugaaaauugguuauaugaagacggagaagaccaaccuaagcaaguguacguugauaagcuagcagagcucaaaaauuugggccagccaauaaaaauaagauuccaagaauccgaagaaagaccgaaacuauucgaagaacuugggaaacaaauacagcaauacaugaagauaaucucaucauuuaaaaacaaagaagaucaauacgaccacuuagacgcagcagacaugacuaaaguagaaaaaucuacgaacgaagcaauggaauggaugaauaacaaacuaaaucuucaaaacaaacaaucacuuacaauggacccaguaguaaaaagcaaagaaaucgaagcgaaaauaaaagaauuaacgagcacauguucaccuauaauaucaaaaccaaaaccaaaaguggaaccaccuaaagaagaacaaaaaaaugcagaacaaaauggaccgguagacgggcaaggagacaauccaggaccucaagcagccgaacagggcacagacacagcaguaccaucagacagcgacaaaaaacuaccggaaauggacauagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7290 - RNA, 2796 nt, Artificial Sequence
  mRNA product Design5 comprising derived and/or modified sequence from Homo sapiens__NP_055093.2 __HsHSPA4L (opt12)
gggagagucccgcagucggcguccagcggcucugcuuguucgugugugugucguugcaggccuuauucaagcuuaccaugagugugguaggaauagaccuuggauuccuaaauugcuacauagcuguagcaagaucaggaggcauugaaacaauagcaaacgaauauagcgaccgaugcacaccagcaugcauaucauuaggaaguaggacuagagccauagguaaugcggcaaaaucacaaauaguaaccaauguaagaaacaccauacauggauucaagaaacuacacggacgcagcuucgacgauccaauaguacaaacagaaagaauuagacuacccuacgaacuacagaaaaugccaaacggaucugcaggagucaaaguaagauaccuugaagaagaacggccauuugcaauugaacaagugacaggaauguuacuugcaaaacuaaaagaaacaagugaaaaugcauuaaagaaaccaguagcagauugcguaauuucaauacccagcuucuucacagacgcagaaagaagaaguguaauggcagcagcacaaguagccggacuaaacugucuaagacuaaugaacgaaacaacagcuguagcuuuagcauacggcauauauaaacaagaucuaccaccacuagaugaaaaaccaagaaacguaguuuuuauagauaugggacacucagccuaccaaguccuaguaugugcuuucaacaaaggaaaauuaaaaguacuugcaacaacauuugauccauaucuaggggguagaaauuucgacgaagcucuaguagacuacuuuugugaugaguucaaaacaaaauacaaaauuaaugucaaagaaaauucaagagcauuacucagacuuuaccaagaaugcgaaaaauuaaagaaacuaaugucugcaaaugcauccgauuuaccgcuaaauaucgaaugcuuuaugaaugaucuugacguaucaagcaaaaugaacagagcacaauuugaacaacuaugugcauccuuauuagcaagaguagaaccuccccuaaaagcgguaauggaacaagcuaaucuccaacgcgaagacauaagcucaauagaaauaguaggcggagcaaccagaauaccggcagugaaagaacaaauaacaaaauuuuucuuaaaagacauuucuacaacuuuaaacgcagacgaagcuguggcuagagguugcgcacuucaaugcgccaucuuaucaccagcguucaaaguccgcgaguucaguauaacagaccugguaccauacaguaucacgcuccgauggaaaacuagcuuugaagacggcucuggggaaugcgaaguauucuguaaaaaucacccagcaccauuuagcaaaguaauaacauuucacaagaaagaaccauucgaacuagaagcauucuacacaaacuuacaugaaguucccuacccagaugcacgaauagguaguuucacaauacaaaauguauucccacaauccgacggagacucaucuaaagucaaagucaaagugcggguaaacauacauggaauauucuccguugcaagugcaagugugauagaaaaacaaaaccucgaaggggaucauucagacgcaccuauggaaacggaaacaaguuucaaaaacgaaaacaaagauaauauggacaaaaugcaaguagaucaagaagaaggacaccaaaaaugccaugcggaacauacucccgaagaagaaauagaucauacaggugcuaaaacaaaaucagcaguauccgacaaacaagacaggcuaaaucaaacacucaagaaaggaaaaguaaaaaguauagaccugccgauacaaagcagucucugucgacaauuaggacaagauuuacuaaauaguuacauagaaaaugaagggaaaaugauuaugcaagauaaauuagaaaaagaaaggaacgaugccaaaaaugcuguugaagaauacguauaugacuuucgcgacagauuaggaacaguauacgaaaaauuuauaacccccgaagaccuaaguaaacuaucugcaguacuagaagacacagaaaauugguuauaugaagauggagaagaucagccaaaacaaguuuacguagauaaacuacaagagcuuaagaaauacggacaaccaauucaaaugaaauauauggaacaugaagaacgcccgaaagcauuaaacgacuuaggaaagaaaauacaauuaguaaugaaaguaauagaggccuacagaaacaaagaugaaagguaugaccaccucgaucccacagaaauggaaaaaguugaaaaaugcauaucagacgcuaugucauggcuaaacagcaaaaugaacgcccaaaacaaauuaucacuuacucaggauccuguaguaaaaguaagcgaaauaguagcgaaaagcaaagaacuagacaacuuuuguaacccuauaaucuauaaaccuaaacccaaagcagaaguaccagaggauaaacccaaagccaauucugaacauaaugggccaauggauggacaauccggcacagaaacaaaaucggacaguaccaaagacucaucacagcacacaaaaagcaguggagaaauggaaguugacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7291 - RNA, 2241 nt, Artificial Sequence
  mRNA product Design5 comprising derived and/or modified sequence from Homo sapiens__NP_005338.1__HsHSPA5 (opt12)
gggagagucccgcagucggcguccagcggcucugcuuguucgugugugugucguugcaggccuuauucaagcuuaccaugaaacucucacuaguagcagcgauguuauuacuuuuaagugcugcacgagcagaggaagaagauaaaaaagaagacguagguacaguaguagguauagaccuaggaacaacauacucauguguaggaguauucaagaauggacgaguagaaauuauagcaaaugaucaaggcaauagaauaacaccaaguuauguagcuuucacacccgaaggagaaagauuaauaggggacgcagcuaaaaaccaauuaacaagcaauccagagaacacaguauuugacgcaaaaagauuaaucggcagaacauggaaugaccccucuguacaacaagauauuaaauuucuaccguuuaaagugguagaaaaaaaaacaaaaccuuauauacaaguagacauaggaggaggacaaacgaaaacauucgcuccagaagaaauaagcgcaaugguuuuaacuaaaaugaaagaaacagcggaagcauauuuaggaaaaaaaguaacucacgcuguaguaacagucccagcauacuuuaacgaugcucaaagacaagccacaaaagaugcaggaacaauugcaggcuuaaauguaaugagaauaauaaaugaaccuacagcagccgcaauagcguacggacuagacaaaagagaaggcgaaaaaaacauacuaguauuugauuuaggaggaggaacauucgauguaagucuacuuacaauugacaacggagucuuugaaguaguagccacaaauggagauacgcaucuaggaggagaggacuucgaccaaaggguuauggaacacuucauaaaauuauacaaaaaaaaaacaggaaaagacguuagaaaagacaauagagccguacaaaaauuaagacgagagguagaaaaagcaaaaagagcauugucaagccaacaccaagcaagaauagaaauagaaucauuuuaugaaggagaggacuucagcgaaacacuuacaagagcaaaauuugaagaacugaauauggauuuauuuagaaguacaaugaaaccaguucaaaaagucuuagaagauagugauuuaaaaaaaagcgacauagaugaaauaguacucguaggaggaucaacaaggauaccaaaaauacaacaauuaguuaaagaguuuuuuaauggaaaagaaccaucacgaggaauaaauccagacgaagcaguagcauacggagcagcaguacaggcaggaguacuaagcggagaucaagauacaggagaucuagucuuacuagaugucugcccacuuacauuaggaaucgaaaccguaggagggguaaugacaaaacuaauaccacguaacacgguugugccaacaaaaaaaucacagauauucaguacagcgucagacaaucagccaaccgucacuauaaaaguauacgaaggagaacgaccacuuacaaaagauaaccaucuacuaggaaccuucgauuuaacaggaauaccacccgccccaagaggaguaccacaaauagaaguuacauucgaaauagacguaaacgguauucuuagagugacagcugaagacaaaggaaccggaaauaaaaauaaaauaacaauaacuaacgaucaaaaccgacuaacuccagaagaaauagaacgcaugguaaacgaugcagaaaaauuugcagaagaagacaaaaaacuaaaagaacgaaucgauacuagaaaugaacuagaaucauacgcauauucauuaaaaaaucaaauaggcgacaaagaaaaacuaggaggaaaauuaucaagugaggauaaagaaacuauggaaaaagcggucgaagaaaaaauagagugguuagaaagucaucaagacgcugauauagaagauuuuaaagcaaaaaaaaaagaauuagaagagauaguacaaccaauaauaucaaaacuauauggaagcgccgguccuccaccaacaggcgaagaagacacagcugaaaaagacgaauuaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7292 - RNA, 2208 nt, Artificial Sequence
  mRNA product Design5 comprising derived and/or modified sequence from Homo sapiens__NP_002146.2__HsHSPA6 (opt12)
gggagagucccgcagucggcguccagcggcucugcuuguucgugugugugucguugcaggccuuauucaagcuuaccaugcaagccccaagagaauuagcaguuggaauagaccuagguacaacauacucauguguaggaguuuuucaacaaggaagaguugagauacuagcaaaugaucaaggaaacagaacaacacccagcuauguagcauucacugacacagaaagauuagucggagacgccgcaaaaucacaagcagcucuaaacccucauaauacaguuuuugaugcuaaaaggcuuauagggagaaaauucgcagacacaacaguacaaucagauaugaaacacuggcccuuucgaguaguaucagaaggaggaaaaccgaaaguaagaguuugcuauagaggagaagauaaaacauuuuacccagaagaaaucucaucaaugguucuuaguaagaugaaagagacagcggaagcauacuuaggacaaccggucaaacacgccguuauaacaguaccugcauauuucaaugacagucaaagacaagcuacaaaagaugcaggagcaauagcaggauuaaauguauuaagaauuauuaaugaaccaacagccgcagcaauagcauacggacuagaucguagaggagccggagaaagaaacgucuuaauauuugauuuaggagggggaacauuugauguaucaguucuaucgauagaugcaggaguauuugaaguaaaagcuacagcaggagauacacauuuaggcggggaagauuuugauaacagauuaguaaaucacuucauggaagaauuuagaagaaaacacgguaaggacuuaucaggaaauaaacgagcacucagaagacuuagaacagccugugaacgagcaaaacguacuuugagcucaaguacacaagcuacuuuagaaauagacaguuuauucgaagguguugauuuuuacacaaguauuacuagagcaagauuugaagaacuauguucagauuuauuucguucaacauuagaaccaguagaaaaagcacuaagagaugcaaaacuagauaaagcucaaauacaugauguggugcuaguaggagguuccacaaggaucccaaaaguccaaaaacuacuacaagauuucuuuaauggcaaagaacucaacaaaaguauaaaucccgaugaagcaguagcauauggugcagcaguacaagcagcaguuuuaaugggagauaagugugaaaaaguacaagauuuacuauuacuagacguagcaccccuaucacucggacuagaaacagcuggaggaguaaugacuacacuaauucaaagaaacgccacaaucccaacaaaacaaacacaaacauuuacaacauacucagauaaucaaccaggcguauuuauacagguuuacgaaggugaacgagcaaugaccaaagacaauaaucuacucgguagauucgaacuaaguggaauaccaccagccccaagaggaguaccacaaauagaaguaacauuugauauagaugcaaaugguauucucagcguaacugcaaccgaccguagcacaggaaaagcuaacaaaauaacuauaacgaaugauaaaggaagacuaaguaaagaagaaguagaacgcaugguacaugaagcagaacaauauaaagcagaagacgaagcacaaagagauagaguugcagcuaaaaacaguuuagaagcacauguguuccauguaaaaggaucauuacaagaagaaucauuaagagauaaaauuccagaagaagauagacgaaaaaugcaagauaaaugcagagaaguacucgcauggcuagagcacaaucaauuagcagagaaagaggaauaugaacaccagaaacgagaauuagaacaaauuugucgaccaauauuuaguagguuauacggaggaccaggagucccaggagguucaucauguggaacccaagcaagacaaggagaucccaguacagguccaauaauagaagaaguugacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7293 - RNA, 1380 nt, Artificial Sequence
  mRNA product Design5 comprising derived and/or modified sequence from Homo sapiens__P48741__HsHSPA7 (opt12)
gggagagucccgcagucggcguccagcggcucugcuuguucgugugugugucguugcaggccuuauucaagcuuaccaugcaagcuccaagagaacuagcuguaggaauagauuuaggaacaacauauaguuguguaggaguauuucaacaaggaagaguugaaauacuagcaaaugaucaagggaauaggacaacaccaucauauguagcauuuacagauacagaacgauuaguaggagaugcagcaaaaucacaggcagcucuaaacccacauaauacaguauuugaugcaaaaagacuaauagguagaaaauuugcagacacuacaguacaaagcgauaugaaacauuggccauuucaaguaguaucagaagguggcaaaccaaaagucagaguauguuauagaggagaagauaaaacuuuuuaucccgaagaaauaucaucaaugguauuaaguaaaaugaaagaaacagcagaagcauaucuaggacaaccaguaaaacaugcgguaauaacaguuccaacauauuuuucaaacucacaaagacaagcaacaaaagaugccggugcaaucgcaggacuuaaaguauuaccaauaauuaaugaagcaacagcagcagcaauagcauauggacuagauagaagaggagcuggaaaaagaaauguauuaauauucgauuuaggagguggaaccuuugauguaucaguauuaagcauagaugcaggaguauuugaagucaaagcaacagcaggagauacacaucuaggaggggaagauuucgauaauagauuaguaaaucacuuuauggaagaguuuagaagaaaacauggaaaagauuuaagcgguaauaaaagagcauuaagaagacuaagaacagcaugcgaaagagcaaaaagaacaccaucaagcaguacgcaagcaacauuagaaauagacucauuauucgaaggaguagacuuuuauaaaucaauaacaagagcgagauucgaagaauuaugcucagacuuauucagaaguacacuagaaccaguagaaaaagcauuaagagaugcaaaacuugacaaagcacaaauacaugauuucguacuaggaggaggauuacacagucauccacaaggagcugaaguagcagcaggacuauuacaacgacaaggugcagaacaagaacaucaaccauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7294 - RNA, 2217 nt, Artificial Sequence
  mRNA product Design5 comprising derived and/or modified sequence from Homo sapiens__NP_006588.1 __HsHSPA8 (opt12)
gggagagucccgcagucggcguccagcggcucugcuuguucgugugugugucguugcaggccuuauucaagcuuaccaugucaaaagguccggcaguaggaaucgauuuaggaacaacauauaguugugucggaguauuucaacauggaaaaguugaaauaauagcaaacgaucaaggcaauagaacuacaccaucuuacguugcauuuacagauacagaaagauuaauaggggacgcagcuaaaaaccaaguagcaaugaacccaacaaauacaguauuugacgcaaaacgacuaauaggaagaagauuugaugaugccguuguacaaucugacaugaaacauuggcccuuuaugguaguaaaugacgcaggaagaccaaaaguccaagucgaauacaaaggagaaacaaagagcuuuuacccugaagaaguuucuagcaugguccuaacaaaaaugaaagaaauugcagaagcguaccuaggcaaaaccguaacaaacgcagucgugacaguaccagcauauuuuaacgauucacaaagacaggcaacaaaagacgcaggaacaauugcaggacucaacguacuccgaauaauaaaugaaccaacugcugcagcaaucgcauauggguuagacaagaaaguaggagcagagcgcaauguacuaauauuugaccuaggaggagguacguucgauguaagcauauuaacaauagaagauggcauauuugaaguaaaauccacagcaggagacacacacuuaggaggagaagauuuugacaauagaauggucaaccauuucauugcagaguucaaaagaaaacacaagaaagauauuucagaaaauaaaagagcaguaagaagauuaagaacagcuugugaaagagcuaaaagaacuuuaucaucaucaacacaagcuagcauagaaauugacaguuuauaugaaggaauagauuucuauacauccaucacgcgagcaagguuugaagaauuaaaugcagacuuauuucgaggaacacuugacccuguugaaaaagcccuacgagacgcuaaacuagacaaaagccaaauacaugacauaguucuaguaggaggaagcacuagaauacccaaaauacaaaagcuacugcaagacuucuucaacggaaaggaacucaacaaaagcauuaaucccgaugaagcaguagcuuacggagcugcaguacaagcugcaauauuaaguggagacaaaagcgaaaacguacaagaucuacuauuacuagauguaacaccucuaagccucggaauagaaacggcaggaggagugaugacaguacucauaaaaagaaauacuacaauaccaaccaaacaaacacaaacauuuacaacauacucagacaaucaaccaggaguauuaauacaaguauacgaaggagaaagagccaugacaaaagacaauaaucuccuaggaaaauucgaauuaacaggaauaccaccagcaccucgcggaguaccacaaaucgaaguaaccuuugacauugaugcgaacggcauauuaaauguuucagccgucgacaagucuacaggaaaagagaacaagauaacaauaacuaaugauaaagggcgauuaagcaaagaagauauagaacgaaugguacaagaagcagaaaaauauaaagcagaagaugaaaaacaaagagauaaaguaucuagcaaaaauagccuagaaaguuaugcauucaauaugaaagccacaguugaagacgaaaaauuacaaggcaaaauaaaugacgaagauaaacagaaaauauuagacaaauguaacgaaauaauaaacuggcuggauaaaaaucaaacggccgaaaaagaagaauuugaacaucaacaaaaagaauuagaaaaaguaugcaauccgauaauaacaaaauuauaccaaucagcuggggguaugccaggggguaugccagguggauucccaggagggggagcaccaccaagcggaggagcaagcucaggaccaacaaucgaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7295 - RNA, 2316 nt, Artificial Sequence
  mRNA product Design5 comprising derived and/or modified sequence from Homo sapiens__NP_004125.3 __HsHSPA9 (opt12)
gggagagucccgcagucggcguccagcggcucugcuuguucgugugugugucguugcaggccuuauucaagcuuaccaugauauccgcaucaagagcagcagcggcaagauuaguaggagcagcagcaaguagaggaccaacagcagcaagacaccaagacaguuggaaugguuuaagccaugaagcauuuagacucgugaguaggagagauuaugcaagugaagccauaaaaggagcugugguaggaauagauuuaggaacaacuaauucauguguugcaguaauggaaggaaaacaggcuaaaguacuagagaaugcggaaggagcuagaaccacucccaguguaguagcauucacagcugauggagaaagauugguagggaugccggcaaaaagacaagcaguuacgaacccaaauaacacauuuuaugcaacaaaacgacuaauagggaggcgauacgaugacccggaaguucaaaaagauauuaaaaacguuccuuuuaagauaguaagagccagcaauggagaugccuggguagaagcccacggaaaguuauauucaccaagucaaauaggggcuuuuguacuaaugaaaaugaaagaaacagccgaaaauuacuuaggacauacugcuaaaaaugcaguuauaacaguaccagcauauuuuaaugauagccaaagacaagcuacaaaagaugcaggucagauaaguggucucaacguucugcgcguaauuaaugaaccaacagcugcugcacuagcauacggguuagauaaaagugaagauaaagucauagcgguauaugauuuaggaggaggcacauuugauauaucaauauuagaaauacaaaaagggguauucgaaguuaaaagcaccaauggagauacguuucuuggaggggaagauuuugaccaagcguuauuaagacauauagugaaagaauuuaagagagagacaggaguagaucuaacaaaagacaacauggcauuacaaagaguuagagaagcugcugagaaggcaaaaugugaauuaagcucaaguguacaaacagauauaaauuuacccuauuuaacaauggauagcaguggaccgaaacaucuaaauaugaaauugaccagagcucaauuugaaggaauagugacagauuuaauaaggagaacaauagcaccaugccagaaagcaaugcaagaugcagaggugaguaaaagcgauaucggagaagugauauugguaggaggaaugacaagaaugccaaaaguacaacaaacaguacaagacuuauuuggcagagcaccaagcaaagcuguuaacccagaugaagcaguggcuauuggagcagcuauacaaggaggaguguuagcaggagauguaacagauguauuauuacuagauguaacaccauuaucauuggguauagaaacacuaggagggguauuuacaaagcuaauaaauagaaauacaacaauaccaacaaagaagucucaaguauucucaacugcagcagaugggcaaacacaaguagaaauaaaaguaugucaaggagaaagagaaauggcaggcgacaauaaacuacuuggacaauuuacacuaauaggcauaccgcccgcccccaggggaguuccacaaauagaaguaaccuucgauauagaugccaacggaauaguacacguaagcgcaaaggacaaagggacagggagagaacaacaaauaguaauacaauccagcggagguuuaucaaaagacgacauagaaaacaugguuaaaaaugcagagaaguaugcagaagaagauagaagaaagaaagaaagaguagaagcaguaaauauggcagaggguauuauacaugauacggaaacaaaaauggaagaauuuaaagaucaauuaccugcagacgaaugcaauaaacuaaaagaagaaauaagcaaaaugagagaauuacuagcaagaaaagauucggaaacuggagaaaauauaagacaagcagcuaguagccugcagcaagccagcuuaaaacuauucgagauggcauauaagaaaauggcaagcgaaagagaaggcagugggagcucaggaacaggugaacaaaaagaagaccaaaaagaagaaaaacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7296 - RNA, 2304 nt, Artificial Sequence
  mRNA product Design5 comprising derived and/or modified sequence from Homo sapiens__NP_079291.2__HsHSPA12A (opt12)
gggagagucccgcagucggcguccagcggcucugcuuguucgugugugugucguugcaggccuuauucaagcuuaccauggcugauaaagaagcuggagguucugauggaccacgagaaacagcuccaacuucugcuuacucaaguccagcaaggucuuuaggagacacgggaauuaccccguuaagucccagucauauagucaacgauacugauucuaacguguccgaacaacaaagcuuucuuguaguaguagcaguugacuucggaacuacuucaucaggauaugcguauucauuuacaaaagaaccagaauguauccacgugaugagacgaugggaaggaggagaucccggaguaagcaaucaaaaaacaccgacaacaauacucuuaacaccagaacgaaaauuccauucauuuggcuacgcagcuagagauuucuaucaugaucuagauccaaaugaagcaaaacaaugguuauaucuugaaaaauuuaaaaugaaacuacauacaacaggugaccucacaauggauacugaucuaacagcagcaaaugggaagaaaguuaaagcacuagaaauauuugcauacgcccuucaauacuuuaaagaacaagcacuuaaagaacuaucagaucaagcaggaucugaauuugaaaauagcgauguuagauggguaauaacaguuccagcaauauggaaacaaccagcaaaacaauuuaugcgccaagcugcauaccaagcaggacucgccucuccagagaauucagaacaauuaauaauugcauuagaaccugaagcagccaguauauauugcagaaaacuaagauuacaucaaaugauugaauuaaguaguaaagcagcaguaaacgguuauagugguucagauacaguaggagcuggcuuuacucaagcaaaagaacauauaagaagaaauagacaaucaaggacauuuuuaguagaaaauguaauuggugaaauaugguccgaauuagaagaaggagacaaauauguagucguagacucugguggcggaacuguagaccuaacaguacaucaaauaagacuuccagaaggacaucuaaaagaauuauauaaagcaacgggaggccccuauggaucauuagguguagauuaugaauucgaaaaauuauuauauaaaauauuuggcgaagauuuuauagaacaauucaaaauaaaaagaccugcggcuuggguagacuuaaugauagcuuuugaaucaagaaaaagagcugccgccccagacagaacaaauccauuaaauauaacauuaccauuuucauuuauugauuauuauaaaaaauuuagaggacacucuguagaacaugcacuuagaaaaagcaacguagauuuuguaaaauggaguucucaaggaauguuaagaaugucaccagacgcaaugaacgccuuguucaaaccaacgauugauaguauaauagaacacuuacgcgacuuauuucaaaaaccagaaguaucaacagucaaauuucuauuuuuagucggaggauuugcagaagcaccacuucuacaacaagcaguacaagcagcauuuggagaucaaugcagaaucauaauaccucaagacguaggccucacgauucuaaaaggcgcagugcuauucggucuagauccagcaguuauaaaaguucggcgaucacccuuaacauauggaguuggaguauuaaaucgauacguagaaggaaaacauccaccagaaaaauuauuaguaaaagacgguacgagaugguguaccgauguauucgauaaauuuauaucagcagaccaaucaguagcucucggcgaacucguuaaaagauccuauacaccagcaaaaccaucucaauuaguuauaguaauuaauauauauucaagcgagcacgauaacguuucauuuauaacagauccagguguaaaaaagugcgguacauuaagacucgacuuaaccggaacaaguggaacagcaguuccagcacgcagagaaauacaaacauuaaugcaauuuggugauacugaaauaaaagcaacagccauagacauagccacaucaaaaucaguuaaaguuggaauagacuuucuaaauuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7297 - RNA, 2337 nt, Artificial Sequence
  mRNA product Design5 comprising derived and/or modified sequence from Homo sapiens__NP_443202.3 __HsHSPA12B (opt12)
gggagagucccgcagucggcguccagcggcucugcuuguucgugugugugucguugcaggccuuauucaagcuuaccauguuagcaguaccagaaaugggauuacagggacuauauauuggaucuucuccagaaagaucaccaguaccaucaccacccgggucaccaagaacccaagaaagcuguggaauagcuccacuaacaccaucacaauccccuaaaccagaaguaagggcaccccaacaagccaguuucaguguuguaguagcaauagauuuuggaacuacaucaucagguuacgcauuuuccuuugcaucagauccugaagcaauucauaugaugagaaaaugggaaggaggagacccuggcguagcacaucagaaaacuccuacauguuuacuuuugacaccagaaggagcauuucauucauuuggauauacagcacgagauuauuaucacgacuuagauccagaagaagcuagagauuggcucuacuuugaaaaauuuaaaaugaaaauacauagugcaacagaucuaacauuaaaaacccaauuagaagcuguuaaugguaaaacuaugccagcgcuagaaguauuugcgcacgcauuaagauuuuuccgagaacaugcauuacaagaacuuagagaacaaucaccuucacuaccugaaaaagauacaguuagauggguauugacuguaccggcaauauggaaacaaccagcgaaacaauuuaugagagaagcugcauauuuagcuggguuaguaucacgagaaaaugcagagcaacucuuaauugcgcuugagccagaagcagcaucugucuacugcagaaaauuaagacuacaucaacuacuagauuuaaguggcagagcacccggagguggaagacuaggugagcgaagaagcauagauucaaguuuccgacaagcaagagagcaacuaagacgaucaagacacucaagaacauuucuaguagaaagcgguguaggagaauuaugggcagaaaugcaagcaggagaucgauauguaguugccgauugcggggguggcacaguagauuuaacaguccaucaacuagaacaaccacacggaacucuaaaagaacuauauaaagcaucaggagguccauacggcgcaguaggaguggacuuagcguucgaacaacuacuaugcagaauauuuggagaagauuuuauagcgacauuuaaaagacaaagaccugcggccuggguagaucuaacaauagcauucgaagcaagaaaacggacggccgggccgcauagagcaggagcucuaaauauaagccuaccauuuucauuuauagacuuuuauagaaaacagagaggacauaacguugaaacugcacugagacgauccucaguaaauuucguaaaauggucuucacaaggaauguugcgaaugagcugcgaagcaaugaaugaacuauuucaaccaacuguaaguggcauuauucaacauauagaagcacuauuagcaagaccugaaguccaaggaguuaaacugcuauuccugguagguggauuugcagaaucggcaguauuacagcaugcaguacaagcagcuuuaggugcaagaggauuacgaguaguaguaccacaugauguaggacuaacaauuuuaaaaggagcuguacuauucggccaagcuccaggaguuguaagaguuagaagaaguccauuaaccuacgggguagggguacuuaauagauucguaccuggacgacauccaccagaaaaauuauuaguaagggauggaagacgcugguguacagauguguucgaaagauucguagcugcugaacagagcguugcucuaggggaagaaguacgaagaucauacuguccagcuagaccaggccaaaggcgaguauuaauaaauuuauauuguugugcagcagaagaugcaagauucaucacugauccaggaguuagaaaaugcggagcacucucucuagaguuagaaccugcggacuguggacaagacaccgcaggagccccaccaggaaggagagaaauacgagcagcaaugcaauuuggugauacagaaauuaaagucacugcaguagauguaucgacaaauagaucaguaagagcuucgauugauuuccuuucgaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7298 - RNA, 1692 nt, Artificial Sequence
  mRNA product Design5 comprising derived and/or modified sequence from Homo sapiens__NP_008879.3__HsHSPA13 (opt12)
gggagagucccgcagucggcguccagcggcucugcuuguucgugugugugucguugcaggccuuauucaagcuuaccauggcucgagaaaugacaauuuuaggaucagcgguauugacacuuuuauuagcaggauaccuagcccaacaauaccuaccacuaccuacaccaaaagugauaggaauagaccuuggaacaacauacuguucaguaggaguauucuuuccaggaacagguaaaguaaaaguaauaccagaugaaaacggacacauaaguauacccucaaugguaaguuuuaccgauaacgauguauacguaggauacgaaucaguugaauuagcagacucaaauccacaaaacacaauauaugacgcaaaaagauuuaucggaaaaaucuucacagcagaggaauuagaagcagaaauaggaagauaucccuucaaaguauuaaauaaaaacggaaugguagaauucucugucacaucaaacgaaacaauaacaguaagcccagaauacguaggcagucgauuacuacuaaaacucaaagaaauggcagaagcguacuuaggaaugccaguagcaaaugccguaauaucagucccagcagaauucgaucuaaaacaacgaaacagcaccauagaagcagccaaucuagcaggauuaaaaauacuaagaguaauaaacgaaccaaccgcagcagccauggcauauggacuacacaaagcagauguauuucacguauuaguaauugaucuaggaggcggaaccuuagacguaucauuauuaaauaaacaaggaggaauguucuuaacuagagccaugucaggaaauaacaaacuaggaggacaagauuuuaaccaacgacucuuacaauacuuauacaaacaaauauaucaaacauauggauuuguuccuagcagaaaagaagaaauacauagacuaagacaagccguagaaaugguuaaauuaaaucuuacacuccaccaaagugcacaacuaagcguguuacuaacaguagaagaacaagacagaaaagaaccacacucuucagacacagaauuaccaaaggauaaauuaucaucagcagaugaccaccgaguaaauucaggauucggaagaggacuaucagauaaaaaaucaggagaaucacaaguucuauucgaaacagaaauaucaagaaaacuauuugacacauuaaacgaagauuuauuccaaaaaauacuaguaccaauacaacaaguacuuaaagaaggacaucuugaaaaaacggaaauagacgaaguaguacucguaggagguucaacaagaauaccaagaauaagacaaguaauucaagaauuuuuuggaaaagacccaaauacauccguagauccagaucuagccguaguaaccggcguagcuauacaagcaggaauagaugguggaucauggccauuacaaguaucagcacucgaaaucccaaacaagcacuuacaaaaaacaaauuucaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7299 - RNA, 1806 nt, Artificial Sequence
  mRNA product Design5 comprising derived and/or modified sequence from Homo sapiens__NP_057383.2__HsHSPA14 (opt12)
gggagagucccgcagucggcguccagcggcucugcuuguucgugugugugucguugcaggccuuauucaagcuuaccauggcagcaaucggaguucaucuaggauguacaagcgcaugcguagcaguauacaaagacggucgagcagguguugucgcaaacgaugcaggagauagaguaacaccagcuguaguagcauauagugaaaacgaagaaauaguaggauuagcagcaaaacaaagcaggauucgaaauauaucaaauacaguaaugaaaguaaaacaaauauuaggccgaagcagcuccgacccucaagcacaaaaauauauagcagaaaguaaauguuuaguaauagaaaaaaauggaaaacuaagauacgaaauugauacgggagaagaaacaaaauucguaaauccggaagauguagcaaggcuaauauuuagcaaaaugaaagaaacagcucauaguguauuaggaagcgacgcaaacgacguaguuauaacagucccuuucgauuuuggagaaaaacaaaaaaaugcucuuggagaagccgcaagagcagccggcuuuaauguacuaagacuaauacaugaaccaucagcagcucuauuagcauauggaaucggacaagauucaccaacagguaaaaguaacauacuaguauuuaaauuaggaggaacaucauuaucacuauccguaauggaaguaaauucaggaaucuauagaguauuaaguacaaacacagacgacaacauuggaggagcacacuuuacagaaacuuuagcacaauaucuugcauccgaauuucaaagaaguuuuaaacaugacguaagagguaacgcaagagcgaugaugaaacugacaaauucagcagaaguagcaaaacauagucuaucaacauuaggauccgcaaacugcuuucuagauaguuuauaugaaggacaagacuuugacugcaauguaucaagagcacguuucgaacucuuauguucaccguuauuuaauaaaugcauagaagcaauaagaggacuauuagaucaaaauggauuuacagcugaugauauaaauaaaguuguguuauguggaggaucaucaagaauaccaaaauuacaacaauuaauaaaagauuuauuucccgcaguagaauuauuaaauucaauaccaccagacgaaguaauuccaauaggcgcagccaucgaagcaggcauacuaauaggaaaagaaaaccuauuaguagaagacucauuaaugauagaauguucagcaagagauauauuaguaaaaggaguagaugaaaguggugcgucaagguuuacaguauuauuuccaagcggaacaccacuaccugcaagaagacaacauacgcuacaagcaccagguaguauaaguucaguaugucuagaacuauaugaauccgacggaaaaaacagcgcaaaagaagaaacaaaauuugcacaaguuguuuuacaagauuuagauaaaaaagaaaacggcuuaagagacauuuuagcaguauuaacaaugaaacgcgauggaucacuacauguaacauguacagaccaagaaacaggaaaaugcgaagcaauaaguauagaaauagcuucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7300 - RNA, 2853 nt, Artificial Sequence
  mRNA product Design5 comprising derived and/or modified sequence from Homo sapiens__NP_006635.2 __HsHSPH1 (opt12)
gggagagucccgcagucggcguccagcggcucugcuuguucgugugugugucguugcaggccuuauucaagcuuaccaugucaguaguaggacuugauguaggaucacaaucauguuacauagcaguagcuagagccggugggauagaaacaauagcaaacgaauuuagugauagaugcacaccaagugucauaucauuugguagcaaaaacagaacaauaggaguagcagcgaaaaaccaacaaauaacccacgcaaacaacacaguaucaaacuucaaaagauuccacggcagagcauuuaacgaccccuucauacaaaaagaaaaggaaaacuugaguuaugacuuaguaccacucaaaaauggaggaguuggaauaaaaguaauguacaugggggaagaacacuuauuuagcguagaacaaauuacugcaaugcuauuaacaaaacuuaaagaaacagcagaaaacucauuaaagaaaccaguaacagauuguguaaucuccguaccaucuuucuuuacagaugcagaaagacgauccgucuuagacgcagcacaaauaguuggccuaaauuguuuaagguugaugaacgacaugacugccguagcccuaaauuaugguauuuacaaacaagacuuaccaagccucgaugagaaaccccggauaguaguauuuguagacaugggacacagcgcauuucaagugagugccugugccuuuaacaaaggaaaacucaaaguucucgguaccgccuuugauccguuuuuaggaggcaaaaauuucgacgaaaaauuagucgaacauuuuugcgcagaauuuaaaacaaaauauaaauuagacgcgaaaagcaaaauaagagcgcuacugagauuauaccaagaaugugaaaaacuaaagaaacuaaugaguucaaauaguacagaccuaccacuaaauauagaguguuucaugaacgacaaagacguaagcggaaaaaugaauagaucacaguucgaagaacuuugugcagaacuauuacagaaaauagaaguucccuuauauucauuauuagaacaaacacacuuaaaaguagaggaugucucagcuguagaaaucgucggaggagccacccguauuccagcggucaaagaaagaauagcaaaauucuuuggcaaagacauaaguacaacccuaaacgccgaugaagcagucgcaagaggaugugcacuccaaugugcaauccuuaguccagccuuuaaaguaagagaguuuuccguaacugacgcaguaccauuuccuauuucucuaauuuggaaucaugauucagaagauacagaaggaguacaugaaguauuuucaagaaaccaugcagcaccguucaguaaaguauugacauuuuugcgaagaggcccauucgaacuagaagcauuuuacucagauccacaagggguaccauaccccgaagcaaaaaucggaagauuuguuguacaaaacgucucagcacaaaaagauggagagaaaagcagaguaaaaguaaaaguacgaguaaacacucauggaauauucacaauaucuaccgcaagcaugguagaaaaagucccaacagaagaaaacgaaaugucaagcgaagccgauauggaaugcuugaaucaacgaccgcccgaaaacccagauacugacaaaaacguacaacaagauaauucagaagcuggaacucaaccacagguacaaaccgaugcacaacaaaccucacaaagcccaccaagucccgaacuuacguccgaagaaaacaaaauaccagacgcagauaaagcaaacgagaagaaagucgaccaaccaccagaagcaaagaaaccgaaaauaaaaguagugaauguagaauuaccaauagaagccaaccuaguguggcaacuaggaaaagaccuccuaaacauguacauugaaacagaaggaaaaaugauaaugcaagauaaauuggagaaagaaagaaacgacgccaaaaaugcaguagaagaauacgucuacgaguucagagauaaacuaugugguccauaugaaaaauucauaugugaacaagaucaccaaaauuuccuuagauuacuuacagaaacugaagauugguuauaugaagaaggcgaagaucaagcaaaacaagccuacgucgacaaauuagaagaauuaaugaaaauaggaacaccagugaaaguaagauuccaagaagcagaagaaagaccaaaaauguuugaagaauuaggucagcgcuuacaacauuacgccaaaauugcagcagauuuuagaaauaaagaugaaaaauauaaccauauugacgaaucagagaugaagaaaguagaaaaaucagucaaugaaguaauggaauggaugaauaauguaaugaacgcucaagcaaagaaaucauuagaccaagacccaguagugagagcccaagaaauaaaaacaaaaauaaaagaauuaaauaauacaugugaaccuguuguuacacaaccaaaaccaaaaauagaaaguccaaaacuagaacgaacgccaaacggaccaaauauagacaagaaagaagaagaucuagaagacaaaaauaacuucggugcagaaccuccacaucaaaacggagaauguuacccaaacgagaaaaacaguguaaacauggacuuagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7301 - RNA, 3276 nt, Artificial Sequence
  mRNA product Design5 comprising derived and/or modified sequence from Homo sapiens__NP_006380.1 __HsHYOU1 (opt12)
gggagagucccgcagucggcguccagcggcucugcuuguucgugugugugucguugcaggccuuauucaagcuuaccauggccgauaaaguaaggcgccaacguccaagaagaagaguauguugggcacuuguugcaguucuacuugcagacuuauuagcacuaagugauacacuugcagugaugaguguagaucuuggauccgaaagcaugaaaguagcaaucguaaaacccggaguaccaauggaaauuguacucaacaaagaaagucgaagaaaaacaccaguaaucguaacucuaaaagaaaaugaaagauuuuucggggauucugcagcaucuauggcaauuaaaaacccaaaagcuacauuacguuacuuccaacauuuacuugguaagcaagcagauaacccucacguugcucuauaucaggcucguuucccagaacaugaacucacauucgacccacaacgacagacaguacacuuucaaauaucaagccaauuacaauucucaccagaagaaguacuagguaugguacuaaacuauucgcgaaguuuagcagaagacuucgcugaacaaccaauaaaagaugccguaauaacagucccagucuucuuuaaccaagcagaaaggagagccguucuacaagcggcuagaauggcaggauuaaaaguauugcaacuaauaaaugacaauacugcgaccgcccuaaguuacggcguuuuucgaagaaaagauauaaauacaacagcccaaaacauaauguucuacgacaugggaaguggaucaacaguaugcacuauaguuacauaccaaaugguaaaaacgaaggaagcaggaaugcaaccacagcuacaaauaagaggaguaggauuugaucguacacuaggaggauuagaaauggaacuaagacuuagagaacgcuuagcaggauuguucaaugaacaaagaaagggccaacgcgccaaggaugugagagagaauccaagagcaauggcaaaauuacucagagaggccaaccgguuaaaaacaguguuaucagcaaacgcagaucauauggcucagauagaaggacugauggaugacguugauuucaaagcaaaagucacacgaguugaauuugaagaguuaugugcagauuuauucgaaagaguuccuggaccuguucaacaagcgcuacaaagugcagaaaugaguuuagaugagauugaacaagugauucuaguuggcggagcaacucgaguuccaagaguccaagaaguacuguuaaaagccguaggcaaagaagaauuagguaaaaauauaaaugccgaugaagcagccgcaaugggagccguuuaucaagcugcugccuuaucgaaagcauuuaaaguaaaaccauuuguuguaagggacgccgugguauacccaauauuagucgaguuuacacgagaagucgaagaagaacccggaauacauucauuaaaacauaacaaacgaguucuauuuucaagaauggggccguauccacaaagaaaaguaauaaccuuuaauagauacucccacgauuuuaauuuccacauuaauuauggagaucuaggauuuuuagguccggaagaucuucguguauuugggucacaaaauuugacaacagucaaacuaaaaggagucggagacucauuuaagaaauauccagauuaugaaucaaaaggaauuaaagcucauuucaauuuggaugaaaguggaguacucagucuagauaggguagaaagcguauuugaaacauuagucgaagacucagcagaagaagaaagcacucugacuaaacuaggaaauacaauaucaucacuauucggaggugggacgaccccagaugcaaaagaaaauggaacagauacuguacaggaagaagaagaaucaccagcagaaggaagcaaggaugaaccaggugagcaaguagaacuaaaagaagaagcagaagcaccaguagaagacggaagucaaccaccuccaccagaaccuaaaggagacgcgaccccagaaggagaaaaagcuacagaaaaggaaaauggagauaaaucagaagcucaaaaaccgucagaaaaagcugaagcaggaccagaaggcguugccccagcaccggagggagaaaagaaacaaaaaccagcaagaaaaagaagaaugguggaagaaaucgguguagagcuaguaguauuagacuuaccugacuuaccagaagauaaauuggcucaauccguucaaaaacuucaagaucuaacacuuagagacuuagaaaaacaagaacgagaaaaagcagcaaacucacuagaagcauuuauauucgaaacacaggauaaacuauaccaaccagaauaccaagagguuucaacugaggaacaaagggaagagaucucaggaaaacucagugcagccaguacaugguuggaagacgaaggaguaggcgcaacaacggucauguuaaaagaaaaacuagcggaacuuagaaaauuaugccaaggauuauuuuucagaguugaagaaagaaagaaauggccagaaagauuauccgcuuuggauaauuuauuaaaucauucaucaauguuucuaaaaggcgcaagauuaauaccugaaauggaucaaauauucacagaaguagaaaugacuacauuagaaaaaguaauaaaugaaacuugggcuuggaaaaaugcuacacuagcagaacaagcaaaauuaccagcuaccgaaaaaccaguacuacuaucaaaagacauagaggcaaaaaugauggcccuagacagagaaguucaauaucuacuaaauaaagcaaaauuuacuaaaccuagaccaagaccuaaagauaaaaaugguacacgagcugagccuccacucaaugcguccgcauccgaucaaggagaaaaaguuauacccccugccggacaaacagaagacgcagagccaaucucagaaccagaaaaaguggaaacaggaagugaaccuggagacacagaaccacuagaacucggagguccgggggcagaaccagaacaaaaagaacagaguacaggacaaaaacgaccgcuaaagaaugaugaguuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7302 - RNA, 2475 nt, Artificial Sequence
  mRNA product Design5 comprising derived and/or modified sequence from Homo sapiens__NP_005339.3 __HsHSP90AA1 (opt12)
gggagagucccgcagucggcguccagcggcucugcuuguucgugugugugucguugcaggccuuauucaagcuuaccaugccagaggaaacccaaacucaagaucaaccaauggaagaagaagaaguagaaacauuugcuuuccaagccgaaauagcacaacugaugucacuaauaauaaauacauuuuauucaaacaaggaaauuuucuugagagaacucauaaguaacucaagcgacgcacucgacaaaauaagauacgaaagccuaacagacccgucuaaacuggacucaggaaaagagcuacauauaaaccuaauaccuaacaaacaagauagaacacuaaccauaguagauacaggaauagguaugacaaaagcagauuuaauaaacaaccuaggcacaauagccaaguccggaaccaaagcguucauggaagcgcuccaagccggcgcagauaucagcaugauaggacaauucgggguaggauucuacucagcauaucuaguagcagaaaaaguaacgguuaucaccaaacauaaugacgacgaacaguacgcaugggaaaguucggcaggcggcucauucacagucagaaccgacaccggggaaccaaugggaagagguacaaagguaauacuacaccuuaaagaagaccaaacagaauaccuagaagaaaggagaauaaaagaaauaguaaaaaaacacucacaauucauuggauacccaauaacauuauuuguagaaaaagaaagagacaaagaaguaagcgacgaugaagcagaagaaaaagaagauaaagaagaagagaaagaaaaagaagagaaagaaagugaagacaaaccagaaauagaagacguuggcucggaugaagaagaagaaaaaaaagacggagauaaaaaaaaaaaaaaaaaaauaaaagaaaaguacauagaucaagaagaacucaauaaaacaaagccaauauggacacgaaauccagaugacauaacuaacgaagaauacggcgaauuuuauaaaaguuuaacaaacgacugggaagaccaucucgcaguaaaacauuuuucaguagaaggacaacuagaauucagagcacuauuauucguccccagaagagcaccauuugauuuauuugaaaauagaaaaaaaaaaaacaacauuaaacuauauguaagaagaguuuucauaauggacaauugugaagaauuaauaccagaauaucuaaacuuuauaagaggggugguugacagcgaagauuuaccgcuuaacauaagccgagaaauguugcaacagaguaaaauacuaaaaguaauaagaaaaaaucuaguaaaaaaauguuuagaauuauuuacggaauuagcagaggacaaagaaaacuacaagaaauuuuacgaacaauucaguaaaaacauaaaauuaggcauacacgaagacagucaaaauagaaagaaacuaucagaacuacuaagauauuacacaagugcaaguggagaugaaaugguaagcuuaaaagacuacuguacaagaaugaaggaaaaccaaaaacauauauauuauauaacaggagaaacaaaagaucaaguagcaaacagugccuucguagaaagacuaagaaaacaugggcuagaaguaauauacaugauagaaccuauagaugaauauugcguacaacaacuaaaagaauuugaaggaaaaacccuaguaucgguaacaaaggaaggauuagaauuacccgaagaugaagaagaaaaaaagaaacaagaagaaaaaaaaacaaaauucgaaaaccuaugcaaaauaaugaaagauauacuagaaaaaaaaguugaaaaaguugugguaucuaacagauuaguaacuucaccaugcugcaucguaacuaguacguauggcuggacagcaaacauggaaagaauaaugaaagcacaggcuuugagagauaacaguaccaugggauauauggcagcaaaaaaacaucuagaaauuaauccagaccacaguauaauagaaacguuaagacagaaagcagaagcggacaagaacgacaaaucaguaaaagaccucguuauacuacucuaugaaacagcacuacuaagcaguggauuuucauuagaagauccacagacacacgcaaacaggauuuauagaaugauuaaacuuggacucggaauagacgaagaugacccaacagcagaugacacaagugcagcagugaccgaagaaaugccaccguuagaaggggaugacgacacuaguagaauggaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7303 - RNA, 615 nt, Artificial Sequence
  mRNA product Design5 comprising derived and/or modified sequence from Homo sapiens__NG_005218__HsHSP90AA3P (opt12)
gggagagucccgcagucggcguccagcggcucugcuuguucgugugugugucguugcaggccuuauucaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauuuauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7304 - RNA, 2451 nt, Artificial Sequence
  mRNA product Design5 comprising derived and/or modified sequence from Homo sapiens__NP_031381.2__HsHSP90AB1 (opt12)
gggagagucccgcagucggcguccagcggcucugcuuguucgugugugugucguugcaggccuuauucaagcuuaccaugccagaagaaguacaccauggagaagaagagguagaaacauucgcauuucaagcagagauugcacaacuaaugaguuugauaauaaauacauuuuauagcaacaaagaaauauuuuuaagagaacuaauuucuaacgcaagcgacgcauuagacaaaauacgauaugagagucuaacugauccaaguaaacuagauaguggaaaggaacuuaaaauagacauaauaccgaauccacaagaacgaacauugacacuaguggacacaggcauaggaaugacaaaggccgaucuaauaaauaaucuuggcacaauagcaaaaagugggacuaaagcguuuauggaggcacuacaagcgggagcagauauaaguaugauaggacaauuuggaguuggauuuuauucagcauacuuaguggcagaaaaaguugucguaauaacaaaacauaacgaugacgaacaauacgccugggaaucaagcgcaggaggaaguuuuacaguaagagcagaccacggugaaccaaucggaaggggaacaaaaguaauacuacacuuaaaagaagaucaaacagaguauuuggaagaacgaaggguaaaagaaguaguaaaaaaacacucacaauuuauaggauauccgauaacauuguaccuagaaaaggaaagggaaaaagaaauaagcgaugacgaagcagaagaagaaaaaggggaaaaggaagaagaagauaaagacgaugaagaaaaaccaaaaauagaggacguaggaagugaugaagaagaugacucaggaaaagauaaaaaaaaaaaaacuaaaaaaaucaaagaaaaauacauagaucaagaagaauuaaauaaaacaaagccaauauggaccagaaacccagacgacauaacacaagaagaauauggcgaauucuauaaaagucuaacaaaugacugggaagaccaccuagcaguaaaacacuucagcgucgaaggucaauuagaauucagagcucuacuauuuauaccaagaagagcaccauucgaucuauucgaaaacaaaaaaaaaaaaaauaauauaaaacucuacguccgcagagucuuuauaauggacucgugcgacgaacuaaucccagaauauuuaaacuuuaucagagggguaguagacucagaggaccucccacuaaacauaagcagggaaaugcuucaacaaagcaaaauccuaaagguaaucagaaaaaauaucgucaaaaaaugccucgaacuauuuucagaauuagccgaagauaaagaaaacuacaaaaaauuuuacgaagcauucagcaaaaauuuaaaacuaggcauacacgaagacuccacaaacagaagaagauuaagcgaauuacuaagauaucacacaucacagucgggagaugaaaugacaucuuuaucagaguacguaagccgaaugaaagaaacacaaaaaaguauauacuauaucacuggagaaaguaaagaacaaguagcgaacucagcauuuguagaacguguaagaaaacgaggauuugaaguaguauacaugacagaaccaauugacgaauacuguguccaacaauuaaaagaauucgaugguaaaaguuuaguuucaguaacaaaagaaggauuagaauuaccugaagacgaagaagaaaagaaaaaaauggaagaaagcaaagcaaaauuugaaaaucuaugcaaacucaugaaagaaauauuagacaaaaaaguggaaaaagucacgauuuccaacagacucguaagcucacccuguugcauaguaacaucuacauaugguuggacugcaaacauggaaagaauaaugaaagcacaagcuuugagagacaauucaacaaugggauauaugauggcaaagaaacauuuagaaauaaacccagaccauccaaucguagaaacacugagacaaaaggcagaagcagacaaaaaugauaaggccgugaaagaucuugugguacuucuauucgaaacagcccuacugaguaguggauucaguuuagaagacccacaaacacacuccaauagaaucuaucgaaugaucaaacuaggauuaggaauagacgaggaugaaguagcugcagaagaaccaaaugcagcaguaccagaugaaauaccaccgcuagaaggagaugaagaugcgagccgcauggaagaaguagacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7305 - RNA, 2688 nt, Artificial Sequence
  mRNA product Design5 comprising derived and/or modified sequence from Homo sapiens__NP_003290.1__HsHSP90B1 (opt12)
gggagagucccgcagucggcguccagcggcucugcuuguucgugugugugucguugcaggccuuauucaagcuuaccaugagagcacuguggguauuaggauuaugcugcguauuacuaacguuuggaucagugagagcagaugaugaagucgauguugauggaacaguagaggaagaccucgguaaaaguagagaaggcucaagaacugacgacgaaguuguucaaagagaagaagaagcgauacaauuagauggauuaaaugcaucacaaauaagagaacuucgugaaaaaucagaaaaauuugcguuucaagcagaaguaaacagaaugaugaaacuaauaauaaauucauuauacaaaaauaaagaaauauuuuuaagagaacuuauuucaaacgcaagcgaugcauuggauaaaauaagauugauaagucuaacagaugaaaacgccuuaucaggaaaugaagaauuaacaguaaaaauaaaaugcgauaaagagaaaaauuuacuacauguaacugacacgggaguaggaaugacaagagaagaauuagucaaaaauuugggaacaauagccaaaucaggaaccucagaauuucuaaacaaaaugacugaagcacaagaagacgggcaaucaacaagugaauuaauaggacaauuugggguaggauucuacagugcguuuuuaguagcggacaagguaauaguaaccaguaaacauaauaacgacacacaacauauaugggagucagacaguaacgaguucaguguaaucgcagacccgagagguaacacauugggacgaggaacaacuauaacguuaguacucaaagaagaggcuucagauuaccuagaacuggauacaauaaagaaucucgugaagaaauauucccaauucaucaacuucccaauauacguauggaguucaaaaacagaaacaguggaggaaccaauggaagaagaagaagcagcuaaagaagagaaagaagaaucagaugaugaagcugcagucgaagaagaagaagaagaaaagaaaccgaaaacuaagaaaguagagaaaacaguuugggauugggaacuaaugaacgacauaaaaccaauuuggcaacgaccgucaaaagaaguggaagaggaugaauauaaagcauuuuacaaaucauucucuaaagaaucagaugauccaauggcauauauacauuuuacagcagaaggggaaguaacauuuaagucaauccuauuuguaccaaccucagcaccgaggggauuauucgacgaauauggaagcaagaaaucggauuauauaaaacuauauguaagaaggguauuuauaaccgaugauuuccacgauaugaugcccaaauaucuaaauuuuguaaaaggaguaguagacagcgacgaucuaccauuaaauguaucucgagaaacacuccaacagcauaaacuccuaaaaguuauaaggaagaaauuagucaggaaaacacucgauaugauaaagaaaauagcagaugauaaauauaacgacacauuuuggaaagaauuugguacaaauauuaaauuaggaguaaucgaagaucacaguaacagaacgagauuagcaaaacuauugagauuucaaaguucacaccacccaacagauauaacuagcuuagaccaauauguggaaaggaugaaagaaaaacaagauaaaauuuauuuuauggcagggaguaguaggaaagaagcugaaaguagccccuucguggaaagauuauuaaagaaaggauaugaaguaauauaucuaacagaaccaguagacgaauauuguauacaagcacuaccagaguucgacggaaaaagauuucaaaauguagccaaagaaggaguaaaauuugacgagucagagaaaacaaaagaaagcagagaagcaguagaaaaagaauuugaaccucuacuuaacuggaugaaagauaaggcuuuaaaagauaaaauagaaaaagcaguaguaagccaaagacuuacagaaucaccaugugcauugguagcaagucaauauggauggaguggaaacauggaaaggauaaugaaagcacaagcguaccaaacaggaaaagauauaucaacgaauuacuaugccagccagaaaaagacauucgaaauaaauccaagacacccauuaauaagagacauguuaagaagaauuaaagaagaugaagaugauaaaacuguauuagaccuugcaguaguuuuguucgaaacggcaacauuacgaaguggcuaucugcuaccggauacaaaagcauauggagacagaauagaacgaauguuaagacuaucauuaaauauagauccugaugccaaaguagaagaagaaccagaagaagaaccagaagaaacggcagaagauacaacagaagacaccgaacaagacgaggaugaggaaauggacguaggaacugaugaagaagaagaaacagcaaaagaaagcacugcagaaaaagaugaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7306 - RNA, 2391 nt, Artificial Sequence
  mRNA product Design5 comprising derived and/or modified sequence from Homo sapiens__NP_057376.2__HsTRAP1 (opt12)
gggagagucccgcagucggcguccagcggcucugcuuguucgugugugugucguugcaggccuuauucaagcuuaccauggcaagagaacuaagagcauuacuauuauggggccgccgacuaagaccucucuuaagagcuccagcacuagcagccguaccaggcggaaagcccauacuauguccaaggagaacaacugcacaacuaggaccaagaagaaauccugcuuggagucugcaagcagguaggcuuuucuccacacaaacagcugaagacaaagaagaacccuuacauucaauaauaucuaguacagaaucuguucaaggaaguaccucaaaacaugaauuucaagcagaaacaaaaaaacuacuagacauaguagcacgaucacuauauagugaaaaagaaguuuuuauaagagaauuaauaaguaacgccucagaugcacuagaaaaauuacgacacaaauuaguaagcgauggucaagcuuuaccagaaauggaaauacauuuacaaacuaacgcugaaaaaggaaccauuacaauacaagauacagguauaggaaugacacaagaagaacuuguuaguaaucuaggaacaauagcucgaucaggaucaaaagcauucuuagacgcauuacaaaaccaagcagaagcuagcucgaaaauaauuggucaauuuggaguaggauuuuauucagcauucaugguugcagacaggguagaaguauauucacguagcgcugcaccaggaucauuagguuaccaauggcuaucagacgguucaggcguuuucgaaaucgcagaagcaucaggaguaagaacaggaacaaaaauaauaauacaccuaaaaagugauuguaaagaguucucuagugaagcaagaguuagagauguaguaacaaaauauucuaauuuuguaucguuuccacuauacuuaaauggacgaagaaugaauacacuacaagcaauauggaugauggauccaaaagauguacgagaauggcaacaugaagaauucuacagauacguugcacaagcacaugacaaaccaagauauaccuuacauuauaaaaccgacgcaccuuuaaauauaagaucaaucuuuuauguuccagacaugaaacccucuauguucgacguaucaagagaacuaggaaguaguguggcccuuuauucaagaaaaguccuaauucaaacaaaagcaacagauauauuaccuaaaugguugagauuuaucagaggaguaguagauucagaagacaucccauuaaaucuaaguagggagcuauuacaagaaucagcauuaauaaggaaacuaagagacguuuuacaacaaagacuuauaaaauuuuuuauagaucaaagcaaaaaagaugcagaaaaauacgcuaaauuuuucgaagacuaugggcuauuuaugagagagggaauaguaacagcaacugaacaagaaguaaaagaagacauugcaaaacuacucagauaugaaaguagugcucugccuagcggucaauuaacaagucugucugaauaugcuucacgaaugagggccggaacaagaaauauauacuacuuaugcgcaccaaaccgacacuuagcagaacauucacccuauuaugaggcaaugaaaaagaaagacacagaaguucuauuuugcuuugaacaauucgacgaacucacuuuacuacaccuaagagaauuugacaaaaaaaaauuaauuagcgucgaaacagauauagugguugaccauuauaaagaagaaaaauuugaggauagaucuccagcggccgaaugccuuucagaaaaagaaacagaagaacuuauggccuggaugagaaacguucuagggucuagaguaacaaaugugaaaguaacauuaagauuagacacacauccggcaaugguaacaguucuagaaaugggagcggcaagacacuuuuuaagaaugcaacaauuggcaaaaacacaggaagaaagagcacaauuauuacagccaacacucgaaaucaacccuagacacgcauuaauaaaaaaacuaaaucaacuaagagcaucagaaccaggacuugcacaauugcuagucgaucaaauauacgaaaaugcaaugauagcagcaggauuaguagaugauccacgagcgaugguaggacgacuaaaugaguuauuaguaaaagcauuagaaagacacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7307 - RNA, 738 nt, Artificial Sequence
  mRNA product Design5 comprising derived and/or modified sequence from Homo sapiens__NP_000609.1__HsIGF1 (opt12)
gggagagucccgcagucggcguccagcggcucugcuuguucgugugugugucguugcaggccuuauucaagcuuaccaugggaaaaauaucaucacuaccaacacaacuauucaaaugcugcuucugcgacuuccuaaaaguaaaaaugcacacaaugucaucaucacaccuauucuaccuagcacuaugcuuauuaacauucacaucaucagcaacagcaggaccagaaacacuaugcggagcagaacuaguagacgcacuacaauucguaugcggagacagaggauucuacuucaacaaaccaacaggauacggaucaucaucaagaagagcaccacaaacaggaauaguagacgaaugcugcuucagaucaugcgaccuaagaagauuagaaauguacugcgcaccacuaaaaccagcaaaaucagcaagaucaguaagagcacaaagacacacagacaugccaaaaacacaaaaagaaguacaccuaaaaaacgcaucacgaggaucagcaggaaacaaaaacuacagaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7308 - RNA, 819 nt, Artificial Sequence
  mRNA product Design5 comprising derived and/or modified sequence from Homo sapiens__NP_000603.1__HsIGF2 (opt12)
gggagagucccgcagucggcguccagcggcucugcuuguucgugugugugucguugcaggccuuauucaagcuuaccaugggaauaccaaugggaaaaucaaugcuaguacuacuaacauuucuagcauucgcaucaugcuguauagcagcauacagaccaucagaaacacuaugcggaggagaauuaguagauaccuuacaauuuguauguggagacagaggauucuauuucucaagaccagcaucaagaguaucaagaagaucaagaggaauaguagaagaaugcuguuucagaucaugugacuuagcauuacuagaaacauauugcgcaacaccagcaaaaucagaacgagauguaucaacaccaccaacaguacuaccagauaacuuuccaagauacccaguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccacuaauugcauuaccaacacaagauccagcacacggaggagcaccaccagaaauggcaucaaacagaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7309 - RNA, 915 nt, Artificial Sequence
  mRNA product Design5 comprising derived and/or modified sequence from Homo sapiens__NP_000591.1__HsIL6 (opt12)
gggagagucccgcagucggcguccagcggcucugcuuguucgugugugugucguugcaggccuuauucaagcuuaccaugaacucauucucaacaucagcauucggaccaguagcauucucacuaggacuacuacuaguacuaccagccgcauucccagcaccaguaccaccaggagaagacucaaaagacguugcagcaccacacagacaaccccuaacauccucagaaagaauagacaaacaaauaagauacauacuagacggaauaucagcacuaagaaaagaaacaugcaacaaaucaaacaugugcgaaucaucaaaagaagcacuagccgaaaacaaccuaaaccuaccaaaaauggcagaaaaagacggaugcuuccaaucagguuucaacgaagaaacaugccuaguaaaaauaauaacaggacuccuagaauucgaaguauaccuagaauaccuacaaaacagauucgaaucaucagaagaacaagcaagagcaguacaaaugucaacuaaaguacuaauacaauuccuacaaaaaaaagcaaaaaaccuagacgcaauaacaacaccagacccaacaaccaacgcaucacuacucacaaaacuacaagcacaaaaccaauggcuacaagacaugacaacacaccuuauacuacgaucauucaaagaauuccuccaaucaucccuccgagcccucagacaaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7310 - RNA, 1557 nt, Artificial Sequence
  mRNA product Design5 comprising derived and/or modified sequence from Homo sapiens__NP_002183.1__HsINHBA (opt12)
gggagagucccgcagucggcguccagcggcucugcuuguucgugugugugucguugcaggccuuauucaagcuuaccaugccauuacuaugguuaagaggauuuuuauuagcuaguugcuggauaauagucagaucaagcccaacgccaggaagcgaaggacacucagcagcuccagacuguccaaguugugcauuagcagcauuaccuaaagauguuccuaauucacaaccagaaaugguagaagcaguaaaaaaacauauauuaaauauguuacacuuaaaaaaaaggccagacguaacacaaccaguuccaaaagcagcauuauugaacgcaauaagaaaauuacacguaggaaagguaggggaaaacggauauguagaaauagaagacgauauaggaagaagagcagaaaugaaugaacuaauggaacaaacaagugaaauaauaacuuucgcagaaagcggaacagcaagaaaaacacuacacuuugaaauaaguaaagaagggagcgauuuaucaguaguagaaagagcagaaguaugguuauuucuaaaaguaccaaaagcaaauagaacuagaacaaaaguaacaauaagacuauuccaacaacaaaaacauccacaaggaucuuuagauacuggagaagaagcggaagaaguaggacuuaaaggagaaagaucagaacuacuauuaagugaaaaaguaguagaugcacgaaaaaguacauggcauguauuuccaguauccaguucaauacaaagacuauuagaucaaggaaaaagcagcuuagacguuagaauagcuugugaacagugucaagaaucaggagcaaguuuaguuuuacuaggaaaaaaaaaaaaaaaagaagaagagggagaagguaaaaaaaaaggugggggagaaggaggagcaggagcugaugaagaaaaagaacaaucacauagacccuucuuaaugcuacaagcaagacaaucagaagaucauccacauagaagaagacgaagaggcuuagaaugugauggaaaaguaaauauauguugcaaaaaacaauucuuuguaucauuuaaagauauaggauggaaugauuggauaauugcacccagcgguuaucaugcaaacuauugugaaggagaaugcccaucacacauagcgggaacuaguggaaguucauuaagcuuucacucaacugugauaaaucauuaucguaugagaggccauucgccguuugcaaauuuaaaaucauguuguguaccaacaaaacuaagaccaaugaguauguuauauuaugacgauggacaaaauauaauaaagaaagacauacaaaauaugauaguagaagaauguggauguaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7311 - RNA, 1500 nt, Artificial Sequence
  mRNA product Design5 comprising derived and/or modified sequence from Homo sapiens__NP_002184.2__HsINHBB (opt12)
gggagagucccgcagucggcguccagcggcucugcuuguucgugugugugucguugcaggccuuauucaagcuuaccauggacggauuaccuggcagagcuuugggagcagcaugucuauuacuauuagcugcaggaugguuaggaccagaagcauggggaucgccaacaccaccaccaacaccagcugcaccaccaccaccaccaccuccugguucaccaggcgggucucaagacaccuguacaagcuguggaggcuuuaggaggccagaagaacuaggaagaguagauggagacuuuuuagaagcuguaaaaagacauauacuuaguagacuccaaaugagaggaagaccaaauauaacacaugccguaccaaaagcugcaaugguaacugcacuucgaaaacuacaugcaggaaaaguaagagaagauggaaggguagaaauaccucaucuagauggacaugcaucaccaggagcagauggacaagaaagaguaucagaaauaauaucuuuugcagaaacagauggauuagcgucaucaagaguaagauuauacuuuuucauaucaaacgaaggaaaucaaaauuuauuuguaguacaagcgagcuuaugguuauaucuaaaauuauuacccuauguuuuagaaaaaggaucaagacgaaaaguaagaguaaaaguuuauuuucaggaacaaggacacggagacagauggaauaugguagaaaagagaguagacuuaaaaagaaguggauggcauacauucccacuaacugaagcaauucaagcacuauuugaaagaggagaaagaagauuaaaccuagaugugcaaugugauucuugucaagaauuagcagucguaccaguauuuguugauccaggagaagaaagucauagaccauuugugguaguucaagcaagauuaggagauaguagacauaggauaagaaaaagaggauuagaaugugauggaaggacaaauuuauguuguagacaacaauucuuuauugacuuuagauuaauaggauggaaugauuggauaauagcacccacaggauauuaugggaauuauugugaaggaaguuguccagcauacuuagcaggaguacccggaucagcaaguuccuuucauacagcaguugucaaccaauaucgaaugagaggguuaaauccagguacaguaaacucauguuguauaccaaccaaacuaaguacuaugagcauguuauauuuugaugaugaauauaacauuguaaaacgagauguaccaaacaugauaguagaagaauguggaugugcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7312 - RNA, 3735 nt, Artificial Sequence
  mRNA product Design5 comprising derived and/or modified sequence from Homo sapiens__NP_000623.2__HsITGAM (opt12)
gggagagucccgcagucggcguccagcggcucugcuuguucgugugugugucguugcaggccuuauucaagcuuaccauggcauuaagaguauuacugcugacagcuuugacucuaugucacggcuucaaccuagacacagaaaaugcuaugaccuuucaagaaaaugcacgagguuucggacagucugucguccaacuacaaggaucaaggguuguagucggcgcaccccaagaaauuguagcagcaaaucaaagaggcuccuuauaucaaugcgacuacucaacagguagcugcgaaccaauacgucuucaaguucccguugaagcagugaacaugucacuugguuuaaguuuagcagcuacaacaagcccaccucaacuauuagcuugcggccccacaguacaccaaaccuguagcgaaaauacuuauguuaaaggauuguguuuccuauucgguuccaauuuacgacagcaaccucaaaaauucccugaagcacuucguggaugcccccaagaagauagcgauauagcauuuuuaaucgacgguuccggauccauaauaccccaugacuuccggagaaugaaagaauuuguaaguacagugauggaacaauugaagaaaucuaaaacucuauuuucucugaugcaauauagugaagaauuuaggauacacuuuacuuuuaaagaauuucaaaacaacccaaauccgagaucguuaguaaaaccgauuacucagcuuuuaggacgaacucauacagcuacuggaauacguaaaguaguaagagaacucuucaacauaacaaauggcgcacguaaaaaugcuuuuaagauauuaguaguaauuacagacggagaaaaauucggagauccucuaggauacgaagacguaauaccagaagcugauagagagggcguaauaagauauguaauaggcguuggagaugcauucagaagcgagaaaagcagacaagaauugaacacaaucgcaucuaaacccccacgagaucauguauuccaggucaauaauuucgaagcucuaaaaacaauacaaaaccaacugagagagaaaauauuugcaauagaagggacacaaacaggcucaucgagcucauuugaacaugaaaugagccaagaaggauuuucagcagcaauaaccucaaacggaccacuauuauccacuguuggaaguuaugauugggcagggggagucuucuuauacacguccaaagaaaaaucuacauuuauaaacaugaccagaguugacagugacaugaaugacgcuuaccucggcuaugcagcagcuauuauacuacgaaauagaguacaaucacuuguuuuaggggcaccacgguaccaacauauuggucuaguugccauguuccgacaaaauacaggaaugugggaaucaaaugccaauguaaaaggaacacaaauaggagcuuauuucggcgcaucauuauguuccguagauguagacucaaacggaucaacagauuuaguccugauuggugccccacauuauuaugaacaaacaagagguggucagguaaguguuuguccgcucccacgagguagagcccgauggcaaugcgaugcuguacuuuauggagaacaaggacagccauggggaagauucggggcagcacuaacaguacuaggugacgugaauggggauaaacuaaccgauguagcaauaggugcaccaggcgaagaagacaauagaggagcaguauacuuauuucacggaacaucaggcucaggaauaagcccuucgcacucacaaagaaucgcuggcaguaaauuaagcccucgccuucaauacuuuggacagucgcuuaguggaggccaagaucuaacaauggacggauuaguugaccuaacgguaggagcacagggucauguccuacuauuacgaucccaaccuguuuugcgugucaaagcaauuauggaguucaauccaagagaaguagcacgaaauguuuuugaaugcaaugaucaaguaguuaaaggcaaagaagcuggagaaguacggguuugucuacauguacaaaaauccacacgagaccgucuacgcgaaggucaaauacaaucaguaguuaccuaugaucuugcacuugacucuggaagaccucacucuagggcuguauuuaaugaaacuaaaaauuccacgagacgacaaacacaaguacuaggucuuacccaaacuugugaaaccuuaaagcuacaacucccaaauugcauagaagauccaguaaguccaauaguacugagacucaauuucucccuugucggaaccccucuaagcgcguucggaaacuuacgaccaguacuagcagaagacgcacagagacuuuuuacugcacuuuuuccauucgagaaaaauugcggaaacgacaauauaugucaagacgacuuaucuauaacauuuucauucaugucauuagauuguuugguaguuggagguccccgggaguucaaugucacaguaacagucagaaaugauggagaagauucuuaccgaacacaaguuaccuuuuucuuuccacuugauuuaagcuaccgaaaagucucuacacuacagaaccaacgaagucaacgcucguggagacuugcaugugaaagcgcuucuucaacugaaguuucaggugcuuugaaaucaacaucauguaguauaaaccaucccauuuuuccggaaaauucugaaguuacauuuaacauuacguucgaugucgauucaaaggcuucucuugguaauaaauuacuauugaaagcaaaugucacauccgaaaauaauaugccaaggaccaacaaaacagaguuccaacuugaauuaccuguaaaauaugcugucuacaugguuguaacaucacauggaguaucuaccaaauaucucaauuuuacagcaucugaaaauacuucacgaguaaugcaacaccaauaccaaguaucaaauuuaggacaacgaucacucccaauuagucuuguuuuucuagucccagucagauugaaucaaacaguaaucugggauagaccacaaguaacauuuucugaaaacuuaagcaguacaugucauacaaaagaacgcuuaccaucccauuccgacuuucuugcugaauuaagaaaagcaccugucgucaauugcucaaucgcagugugccaacgaauacaaugugacauucccuucuuuggcauacaagaagaguuuaacgcuacacuaaagggcaauuuauccuuugacugguacauaaaaacaucacauaaucaucuauuaauuguaucaacagcagaaauauuauuuaacgacagcguauucacacuucuccccgggcaaggagcuuuugucagaagucaaacagaaacaaaaguagaaccauucgaaguuccaaaccccuuaccucucauaguagguuccucgguagguggauuacuacugcuugcauuaauuacagccgcuuuauauaaacuuggauucuuuaagagacaauauaaggauaugaugucugaaggaggaccuccuggcgcagaaccacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7313 - RNA, 1680 nt, Artificial Sequence
  mRNA product Design5 comprising derived and/or modified sequence from Homo sapiens__NP_002415.1__HsMMP8 (opt12)
gggagagucccgcagucggcguccagcggcucugcuuguucgugugugugucguugcaggccuuauucaagcuuaccauguucucacuuaaaacucucccauucuuacuacuacuacacguccaaauaucaaaagccuuccccguauccucaaaagaaaaaaauacuaaaacaguucaagacuaccucgaaaaauucuaccaacuaccuucaaaccaauaccaaucaacaagaaaaaaugguacuaaugucauagucgaaaaauuaaaagaaaugcaaagauuuuuuggacuuaacguuacaggaaaaccuaacgaagaaacccuagacaugaugaaaaaaccacgaugcggagucccagacucaggaggcuucaugcuaacaccaggaaauccaaaaugggaacguacaaacuuaacauaccgcauacgaaacuacaccccacaacuaagugaagcagaaguagaacgcgccauaaaagacgccuucgaacuauggucaguagcaagcccacucauauuuacuagaauaucacaaggugaagcugauaucaauaucgcauuuuaccaacgagaccacggcgauaacucaccauucgacggcccaaauggaauacuagcccacgcauuccaaccaggacaaggaauaggaggugacgcacacuucgacgcagaagaaaccuggacaaacacaucagcaaacuauaacuuauuucuagucgccgcacacgaauucggacacucacuagguuuagcacacucaucagacccaggcgcacuaauguaucccaacuaugcauucagagaaaccucaaauuauucauuaccucaagacgauauagacggaauucaagcaauauauggacuuucuucaaauccaauacaaccaacaggcccuucaaccccaaaacccugugaucccucacuaacauucgacgcaaucacaacucuacgaggagaaauuuuauucuuuaaagacagauauuuuuggagaagacacccacaacuacaaagaguagaaaugaacuucauaagcuuauucuggccaucacuaccaacaggcauucaagcagcauacgaagacuucgauagagaccuaauauucuuauuuaaaggaaaccaauauugggcacuaucagguuacgacauacuacaaggauacccaaaagacauauccaauuauggauucccaucaucaguacaagcaauagacgcagcaguauucuauagaucaaaaaccuacuucuucguaaaugaucaauucuggagauacgacaaccaacgccaauucauggaacccggauaucccaaaucaauaucaggagcauucccaggaauagaaucaaaaguagacgcuguauuccaacaagaacauuucuuucaugucuucuccggacccagguacuacgcauuugauuuaauagcccaaagaguaacacgaguagcaagaggaaauaaaugguugaauuguagauacggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7314 - RNA, 2400 nt, Artificial Sequence
  mRNA product Design5 comprising derived and/or modified sequence from Homo sapiens__NP_004985.2__HsMMP9 (opt12)
gggagagucccgcagucggcguccagcggcucugcuuguucgugugugugucguugcaggccuuauucaagcuuaccaugagccuuuggcaacccuuaguuuuaguuuuacuaguauuaggaugcugcuucgcagcuccuagacaaaggcaaucaacacuuguucucuuuccaggagacuuacgaacaaaucuaacagauagacaacuagcagaagaauacuuauauagauauggauauaccagaguugcagaaaugagaggagaaaguaaaucguuaggaccugcccuacuacuucuucaaaaacaauuaucauuaccagaaacaggagaacuagauucugcuacacuaaaagcaaugagaaccccuagaugcggaguuccagauuuaggccgauuucaaacauuugaaggagaccuaaaauggcaccaucauaauauaacuuauuggauacaaaauuacucugaagacuuaccgagagccguaauagacgaugcauucgcuagagcauuugcuuuauggucagcaguuacaccccuaacauuuacuagaguauauucaagagaugcugauauaguaauucaauuuggagucgcagaacauggugauggauauccauuugauggaaaagacggauuauuagcccacgcauucccaccugguccaggcauucaaggagaugcacauuucgacgaugacgaauuauggagcuuaggaaaaggaguaguaguaccuacacgcuuugggaaugcugauggagcagcaugccauuucccauuuauuuucgaagguagaucauacucugcaugcacuacagauggaagauccgauggauuaccuuggugcagcacaacagcuaauuaugacacugaugacagauuugguuuuuguccauccgaaagacuuuacacacaagacggaaaugcagaugguaaaccaugccaauuuccuuuuauauuucagggacaaucauauucagcuuguacaacagaugggagaagugauggauaccgcuggugugcaaccacugccaauuaugauagagacaagcuauuuggauucuguccuacaagagcagacucgacuguaauggguggaaauucagccggagaacuaugugucuucccauuuacauuuuuagguaaagaauacucuacauguacuucagaaggccguggugauggaagacuuuggugugcaacaacaucaaauuucgacucugacaaaaaauggggauuuuguccagaucaaggauacagcuuauuucuaguugcagcacacgaauuuggacaugcacuagguuuagaucacaguucaguaccagaagcauuaauguauccaauguauagauuuaccgaagggccuccccuucacaaagaugacguuaauggaauaagacacuuauacggacccagaccugaaccugaaccaagaccuccuacuacaacuacuccacaaccaacagccccaccaacaguaugcccaacgggaccgccaacaguacacccaagcgaaagaccaacugcuggaccaacaggaccacccagugcagguccaacugguccaccuacagcaggcccaucuacugcaacaacagucccauuaaguccaguggacgaugcaugcaacguuaacauauucgacgcaauugcagaaauuggaaaucaauuauaucuuuuuaaagauggaaaauacuggagguucucagaaggaagagguucaagaccacaagguccauuucuuauagcugauaaauggccagcucuccccagaaaauuagacucaguauucgaagaacgauuaaguaaaaaauuauucuucuuuucaggcagacaaguuuggguauauacuggugcaaguguacucggaccaagaagacuugauaaauuaggcuuaggggcagacguugcacaaguaacuggagcccuaagauccggucgaggaaaaauguuauuauucucaggaagaagauuauggagauuugauguuaaagcacaaaugguugauccaagaucagcaucagaaguagacagaauguuuccaggcguaccacuagauacucaugacguauuucaauaucgggaaaaagcguacuuuugucaagauagauuuuauuggagaguuucuucaagaucagaauuaaaccaaguagaucaaguuggauauguaacauaugauauccuacaaugcccagaagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7315 - RNA, 1692 nt, Artificial Sequence
  mRNA product Design5 comprising derived and/or modified sequence from Homo sapiens__NP_002418.1__HsMMP13 (opt12)
gggagagucccgcagucggcguccagcggcucugcuuguucgugugugugucguugcaggccuuauucaagcuuaccaugcacccaggaguacuagcagcauucuuauucuuaucuuggacccacuguagagcacuaccucuaccuagcggaggagaugaagaugaccucucagaagaagaccuacaauucgcagaaagauaucuacgaucuuauuaccacccaacaaacuuagcaggaauacuaaaagaaaacgcugcaucaucaaugacagaaagacuaagagaaaugcaaucauuuuucggacuagaaguaacaggaaaauuagacgacaacacauuagacguaaugaaaaaaccaagaugcggaguaccagaugucggagaauacaacgucuucccaagaacauuaaaauggagcaaaaugaaccuaacauauagaauaguaaauuacacacccgacaugacacacucagaaguagaaaaagcauuuaaaaaagcauucaaaguaugguccgaugucacaccccuaaacuucacaagauuacaugacggaauagcagacauaaugauaucuuucggaauaaaagaacacggugacuucuacccuuucgacggaccaucaggacuauuagcacacgcauucccacccggaccaaauuacggaggagaugcacacuuugacgaugaugaaacuuggacaucaucaucaaaagguuauaacuuauuucucguagcugcccacgaauucggacacucacuagggcuagaccacagcaaagaccccggagcauuaauguuuccaauuuauacauauacaggaaaaagucacuuuaugcuaccggacgacgacguacaaggcauacaaucacucuacgguccaggagacgaagacccaaacccaaaacaccccaaaacaccagauaaaugcgacccaucacuaucauuagaugcaauaacaucauuaagaggagaaacuaugauuuucaaagacagauucuucuggagguuacacccccaacaaguagaugcagaacucuuucuaacaaaaucauuuuggccagaauuaccaaauagaauugacgcugcauacgaacacccaucacacgaccuaauauuuauauucagaggaagaaaauucugggccuuaaacggauaugacauacuagaaggauacccaaaaaaaauaucagaauuaggucuacccaaagaaguaaaaaaaauaucagcagccguccacuucgaagacacuggaaaaacauuacucuuuaguggcaaccaaguauggagauaugacgauacaaaccacauaauggauaaagacuacccaagauuaauagaagaagacuuuccaggaauuggagacaaaguagacgccguauacgaaaaaaauggauacauauacuuuuucaacggaccaauucaauucgaauauuccauauggucaaaccgaauaguuaggguaaugccagcaaacuccauauuaugguguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7316 - RNA, 1344 nt, Artificial Sequence
  mRNA product Design5 comprising derived and/or modified sequence from Homo sapiens__NP_001286.1__HsCCR1 (opt12)
gggagagucccgcagucggcguccagcggcucugcuuguucgugugugugucguugcaggccuuauucaagcuuaccauggaaacaccaaauacaacagaagacuaugacacaacuacagaauucgacuauggcgacgccacaccaugccaaaaaguaaacgaaagagcauucggcgcacaauuauuaccaccuuuauacucauuaguauucguaauaggauuaguaggaaacauacuaguaguauuaguacuaguacaauacaaaagacuaaaaaacaugacauccauauaccuacuaaacuuagcaauaucugaccuacuauuccuauucacucuaccauucuggaucgacuauaaacuaaaagaugacuggguuuucggugacgcaaugugcaaaauccucucaggauuuuacuacacaggauuauacagcgaaaucuuuuucaucauacuauuaaccaucgaccgauaccuagccauaguacacgcaguauucgcacucagagccagaacaguaacuuucggcguaauaacaucaauaauaaucugggcauuagccauacucgcaucaaugccaggacuauacuucucaaaaacacaaugggaauucacccaucacacaugcucauuacacuucccucacgaauccuuaagagaauggaaacuauuucaagcccuaaaauuaaacuuauucggacuaguacuaccuuuacuaguaaugauaaucuguuacacaggaauuauaaaaauacuacucagaagacccaacgaaaaaaaaucaaaagccguaagauuaauauucguaauaaugauaauuuucuucuuauucuggacaccauacaacuuaacaauacucauuuccgucuuccaagacuucuuauucacucacgaaugcgaacaaucaagacaucuagaccuagcaguccaagucaccgaaguaauagcauacacacacugcugcguaaacccaguaauuuacgcauucguaggagaacgauucagaaaauaccuuagacaacuuuuucacagaagaguagcaguccaccuugucaaauggcuaccauuuuuaucuguagacagacuagaaagaguaucuucaacaucaccaucuacaggagaacacgaacucucugccggcuuuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7317 - RNA, 912 nt, Artificial Sequence
  mRNA product Design5 comprising derived and/or modified sequence from Homo sapiens__NP_002598.4__HsPDGFA (opt12)
gggagagucccgcagucggcguccagcggcucugcuuguucgugugugugucguugcaggccuuauucaagcuuaccaugcgaacacuagccugccuauuacuacuaggaugcggauaccuagcacacguacuagcagaagaagcagaaauaccaagagaaguaauagaaagacuagcaagaucacaaauacacaguauaagagaccuacaaagacuacuagaaauagacucaguaggaucagaagacucacuagacacaucacuaagagcacacggcguacaugcaacaaaacacguacccgaaaaaagaccauuaccaauaagaagaaaaagaagcauagaagaagccguaccagcaguauguaaaacaagaacaguaauauacgaaauaccaagaagccaaguagacccaacaucagccaacuucuuaauauggccaccaugcguagaaguaaaaagaugcacaggaugcugcaacacaagcagcgucaaaugccaaccaaguagaguacaccaucgaucaguaaaaguagcaaaaguagaauacgucagaaaaaaaccaaaacuaaaagaaguacaaguaagacucgaagaacaccuagaaugcgcaugcgccacaacaagccuaaacccagacuacagagaagaagacacaggaagaccaagagaaucaggaaaaaaacgaaaaagaaaaagacuaaaaccaacuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7318 - RNA, 1002 nt, Artificial Sequence
  mRNA product Design5 comprising derived and/or modified sequence from Homo sapiens__NP_002599.1__HsPDGFB (opt12)
gggagagucccgcagucggcguccagcggcucugcuuguucgugugugugucguugcaggccuuauucaagcuuaccaugaacagaugcugggcacuauuccuaucauuaugcuguuacuuaagacuaguaucagcagaaggagauccaauaccagaagaauuauacgaaauguuaagugaucacucaauaagaagcuuugacgauuuacaaagacuacuacauggagauccaggagaagaagacggagcagaacuugaucuaaauaugacaagaucacacaguggaggagaauuagaaucacuagccagaggaagaagaagucuaggaucacucacaaucgcagaaccagcaaugauagcagaauguaaaacaagaacagaagucuucgaaaucucaagacgacuaauagacagaacaaaugcaaacuucuuaguauggccaccaugcguagaaguacaaagaugcucaggaugcugcaauaacaggaacguacaauguagaccaacacaaguacaacuaagacccgugcaaguaagaaaaauagaaauaguaagaaaaaaaccaaucuuuaaaaaagcaacaguaacacuagaagaucaucuagcaugcaaaugcgaaacaguagcagcugcaagaccaguaacaagaucaccaggaggaagccaagaacaaagagcaaaaacgccacaaacaagaguaacaauaagaacaguuagaguaagaagaccaccaaaaggaaaacauagaaaauucaaacacacacacgauaaaacagcauuaaaagaaacauuaggagcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7319 - RNA, 1314 nt, Artificial Sequence
  mRNA product Design5 comprising derived and/or modified sequence from Homo sapiens__NP_057289.1__HsPDGFC (opt12)
gggagagucccgcagucggcguccagcggcucugcuuguucgugugugugucguugcaggccuuauucaagcuuaccaugucauuauucggauuauuacuuuuaacaucugcauuagcaggacaaagacaaggaacacaagcagaaucaaaccuaucaagcaaauuucaauuuucaucaaauaaagaacaaaauggcguacaagauccacaacacgaaagaauaauaacaguaagcacuaacggaucaauacacagcccccgauucccacauacauacccaagaaacacaguauuaguauggagauuagucgccguagaagaaaauguauggauacaacuuacauucgaugaaagauucggauuagaagaccccgaagacgacauaugcaaauacgacuucguagaaguagaagaacccucagacggaacaauauuaggucguuggugcggaucaggaacaguaccaggaaaacaaauaaguaaaggaaaccaaauaagaauucgauucguaucagaugaauacuuuccaucagaaccaggauucugcauccauuacaauauaguaaugccacaauuuacagaagcaguaucaccaagcguauuaccaccaucagcccuaccucuagacuuauuaaauaacgcaauaacagcauuuagcaccuuagaagacuuaauacgauacuuagaaccagaacgauggcaacuagaccuugaagaccuauacagaccaacauggcaauuacuaggaaaagcauucgucuuuggcagaaaaucaagaguaguagaucuaaaccuacuaacagaagaaguaagauuauacaguugcacaccuagaaacuucucaguaagcauaagagaagaacuaaaaagaacagacaccauauucuggccaggaugccuacuaguuaaaagaugcggaggaaauugcgcauguugcuuacacaacuguaacgaaugccaaugcguacccucaaaaguaacaaaaaaauaccacgaaguacuacaauuaagaccaaaaacaggaguaagaggacuccacaaaucacuuacagacguagcacuagaacaccacgaagaaugugacugcguaugcagaggcucaaccggaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7320 - RNA, 1371 nt, Artificial Sequence
  mRNA product Design5 comprising derived and/or modified sequence from Homo sapiens__NP_149126.1__HsPDGFD (opt12)
gggagagucccgcagucggcguccagcggcucugcuuguucgugugugugucguugcaggccuuauucaagcuuaccaugcauagauuaauauucguauacacacuaauaugugcaaacuucugcucaugcagagacaccagugcaacaccccaaagcgcaucaauaaaagcacuacgaaacgcaaacuuaagaagagacgaucuauauagaagagaugaaacaauacaaguaaaaggaaacggauacguacaaucaccacgauuuccaaauucauacccacgaaaccuauuauuaacauggcgacuacacucacaagaaaauacaagaauacaacuugucuucgacaaccaauucggacuagaagaagcagaaaaugacauaugcagauaugacuucguagaaguagaagacauaucagaaacuucaacaauaauaagaggaagaugguguggacacaaagaagucccaccaagaauaaaaucaagaacaaaccaaauaaaaauaaccuucaaaucagaugacuacuucguagcaaaaccgggcuuuaaaauauacuauagccuauuagaagacuuccaaccagcagcagcaucagaaaccaacugggaaucaguaacaagcucaauaucuggaguaucauacaacucaccaucaguaacagauccaacacuaauagcagacgcauuagacaaaaaaauagccgaauucgacacaguagaagaucuacuaaaauacuucaacccagaaucauggcaagaagaccuagaaaacauguaccuagacacaccaagauacagaggaagaucauaccaugacagaaaaaguaaaguagaccuagacagacuaaacgacgaugcaaaaagauacagcugcacaccaagaaauuacucaguaaacauaagagaagaacuaaaacuagcaaacguaguauucuucccaagaugcuuauuaguacaaaggugcggaggaaauuguggaugcggaacaguaaacuggagauccuguacaugcaacucaggcaaaacagucaaaaaauaccacgaaguacuacaauucgaaccaggacacauaaaaagaagaggcagagcaaaaacaauggcacuaguagacauacaacucgaucaccacgaaagaugcgacuguauaugcucaagcagaccaccacgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7321 - RNA, 954 nt, Artificial Sequence
  mRNA product Design5 comprising derived and/or modified sequence from Homo sapiens__NP_003946.3__HsSOCS3 (opt12)
gggagagucccgcagucggcguccagcggcucugcuuguucgugugugugucguugcaggccuuauucaagcuuaccaugguaacacacucaaaauucccagcagcaggaaugucacgaccucuagacacaucauuacgacuaaaaacauucucaucaaaaucugaauaccaacuaguaguaaacgcaguaagaaaauuacaagaaucaggauucuacuggucagcaguaacaggaggagaagcaaaccuacuauuaucagcagaaccagcaggaacauuccuaauaagagacucaucagaccaaagacacuucuuuacacuaucaguaaaaacccaaucuggaacaaaaaaccuacgaauacaaugugaaggaggauccuucucucuacaaucagacccaagaucaacacaaccaguacccagauuugacugcguacuaaaauuaguacaccacuacaugcccccacccggagcaccaucauucccaucacccccaacagaacccucaucagaaguaccagaacaaccaucagcacaaccacuaccaggcucaccaccaagaagagcuuauuacauauacuccggaggagaaaaaauaccacuaguucuaucaagacccuuaucaucaaacguagccacacuacaacaccuaugcagaaaaacaguaaacggacacuuagacucauacgaaaaaguaacacaacuuccaggaccaauaagagaauucuuagaucaauacgacgcaccauuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7322 - RNA, 759 nt, Artificial Sequence
  mRNA product Design5 comprising derived and/or modified sequence from Homo sapiens__NP_003227.1__HsTGFA (opt12)
gggagagucccgcagucggcguccagcggcucugcuuguucgugugugugucguugcaggccuuauucaagcuuaccaugguaccaucagcaggacaauuagcauuauucgcauuaggaauaguauuagcagcaugucaagcauuagaaaauucaacaucaccauuaucagcagacccaccaguagcagcagcaguaguaucacauuuuaaugauugcccagauucacauacacaauucugcuuucauggaacauguagauuuuuaguacaagaagauaaaccagcauguguaugucauucaggauauguaggagcaagaugugaacaugcagauuuauuagccguaguagcagcaucacaaaaaaaacaagcaauaacagcauuaguaguaguaaguauaguagcauuagcagucuuaauaauaacauguguauuaauacauuguugucaaguaagaaaacauugugaauggugcagagcauuaauauguagacaugaaaaaccaucagcacuauuaaaaggaagaacagcauguugucacucagaaacaguaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7323 - RNA, 1449 nt, Artificial Sequence
  mRNA product Design5 comprising derived and/or modified sequence from Homo sapiens__NP_000651.3__HsTGFB1 (opt12)
gggagagucccgcagucggcguccagcggcucugcuuguucgugugugugucguugcaggccuuauucaagcuuaccaugccaccaaguggauuaagacuacuaccauuacuauuaccacuauuauggcuacuaguauuaacaccuggaagaccagcugcaggccuaucaaccugcaaaacaauagacauggaacuaguaaaacgaaaaagaauagaagcaauaagaggccaaauacuaucaaaacuaagauuagcaucaccaccuucccaaggagaaguaccaccaggcccacuaccagaagcaguacuagcacuauacaacuccacaagagacagaguagcaggcgaaucagccgaaccagaaccagaaccagaagcugacuacuacgcaaaagaaguaacuagaguauuaaugguagaaacacacaacgaaaucuaugacaaauuuaaacaaucuacacauucuauauauauguucuucaauacaagcgaauuacgagaagcaguacccgaaccaguacuauuaucaagagcugaacuccgauuacuaagauuaaaacuaaaaguagaacaacacguagaacuauaccaaaaauauucuaauaauucauggagauaucuuagcaauagauuacuagcaccauccgacucaccugaauggcuaucauuugauguaacaggaguaguacgucaauggcuaucacgaggcggagaaauagaaggauuuagauuaagcgcucacugcagcugugacucaagagacaacacauuacaaguagacaucaacggauucacaacaggaagaagaggagaucuagccacaauacacggaaugaacagaccauuucuacuauuaauggcaacaccacuagaaagagcacaacaucuacaaucuucaagacacagaagagcauuagacacaaacuacugcuuuucaagcacagaaaaaaauugcugcgucagacaauuauauauagauuucagaaaagauuuaggcuggaaauggauacaugaaccaaaaggauaccacgcaaacuucugccuaggaccaugcccauacauuuggucauuagauacccaauacucaaaaguucuugcauuauacaaccaacacaacccuggagcaagugcagcaccauguugcguaccccaagcauuagaaccacuaccaauaguauauuacguuggccgaaaacccaaaguagaacaacuaucaaacaugauagucagaucauguaaauguucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7324 - RNA, 1521 nt, Artificial Sequence
  mRNA product Design5 comprising derived and/or modified sequence from Homo sapiens__NP_003229.1__HsTGFB2 (opt12)
gggagagucccgcagucggcguccagcggcucugcuuguucgugugugugucguugcaggccuuauucaagcuuaccaugcacuacugcguacucucagccuuccuaauacuacaccuaguaacaguagcauuaagcuuaucaacaugcucaacacuagacauggaucaauucaugagaaaaagaauagaagcaauaagaggccaaauacuaucaaaacuuaaauuaacaucaccaccagaagacuaucccgaaccagaagaaguaccaccagaaguaauaucaauauauaacucaacaagagaccuauuacaagaaaaagcaagccgaagagcagcagcaugcgaacgagaaaggucagacgaagaauacuacgccaaagaaguauacaaaauagacaugccacccuucuucccaucagaaaaugccauaccccccacauuuuacagaccauacuucagaaucguaagauucgacguaucagcaauggaaaaaaacgcaucaaaucuaguuaaagcagaauucagaguauucagacuacaaaacccaaaagcaagaguaccagaacaaagaauagaacuauaccaaauacuuaaauccaaagaucuaacaucaccuacacaaagauauauagacucaaaaguaguaaaaacuagagcagaaggcgaauggcuauccuucgacguaacagacgccguucacgaauggcuucaccacaaagaccgaaacuuaggauucaaaauaucacuucacuguccauguugcacauuuguccccucaaauaacuacauaauccccaauaaaucagaagaacucgaagcaagauucgccggaauagacggaacuagcacauauaccuccggagaccaaaaaaccauaaaaucuacaagaaaaaaaaacucuggaaaaacaccacacuuacuauuaaugcuacuacccucauaccgacucgaaucucaacaaacaaacagacgaaaaaaaagagcauuagacgccgcuuauuguuucagaaauguacaagauaacugcugccuacgaccacuauacauagauuucaaaagagaucuaggcuggaaauggauccaugaaccaaaaggcuauaacgcaaacuucugcgcuggagcaugcccauaccuauggucaucagacacacaacauucaagaguauuaucacuuuacaacaccauaaaucccgaagcaucagcaagccccuguugcguaucacaagaccuagaaccacuaaccauccuauacuauauaggaaaaacuccaaaaauagaacaacuaucuaauaugauaguaaaaucaugcaaaugcucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7325 - RNA, 1515 nt, Artificial Sequence
  mRNA product Design5 comprising derived and/or modified sequence from Homo sapiens__NP_003230.1__HsTGFB3 (opt12)
gggagagucccgcagucggcguccagcggcucugcuuguucgugugugugucguugcaggccuuauucaagcuuaccaugaaaaugcacuuacaaagagcccuaguaguccuagcuuuacuuaacuucgcaaccguaucccuaagccuaucaacuuguacaacccuagacuuuggacacauaaaaaaaaaacgcguagaagcaauuagaggacaaauauuaucuaaacuaagauuaaccucaccaccagaaccaacaguaaugacacauguaccauaccagguauuagcacuauacaauucaacacgcgaacuacuagaggaaaugcauggagaaagagaagaaggaugcacacaagaaaacacagaaucagaauacuacgcaaaagaaauccauaaauucgacaugauacaaggauuagcagaacacaacgaacuagcaguaugcccaaaaggaauaacaucaaaaguauuuagauucaauguaucuucaguugaaaaaaauagaacuaaccucuuuagagccgaauuccgcguauuaagaguccccaacccaagcagcaaacgaaacgaacaaagaauagaacuauuccaaauacuaaggccagacgaacacauagcaaaacaaagauauauaggaggcaaaaauuuacccacaagagguacagcagaauggcuaucauucgauguaacagauaccguaagagaauggcuacuaagaagagaaaguaaucuaggccuagaaauaucaauacauuguccaugucacacauuccaaccaaacggagacauauuagaaaacauacacgaaguaauggaaauaaaauucaaaggaguagacaacgaagaugaucacggacgaggcgaucuaggcagauuaaaaaaacaaaaagaccaccacaauccacaccuaauauuaaugaugauaccaccacacagacuagacaauccaggccagggaggccaaagaaaaaaaagggcacuagacaccaacuacugcuucagaaaccuagaagaaaacugcugcguaagaccacuauacauugacuucagacaagaccuaggcuggaaauggguccaugaaccaaaaggauacuacgccaacuuuugcucaggaccaugcccauaccucagaucagcagacacaacccacucaacaguauuagguuuauacaacacauuaaacccagaagcaagugccuccccuuguugcguaccacaagaccuagaaccauuaaccauauuauauuauguaggacgaacaccaaaaguagaacaacuaucaaauaugguaguaaaaucaugcaaauguagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7326 - RNA, 1662 nt, Artificial Sequence
  mRNA product Design5 comprising derived and/or modified sequence from Homo sapiens__NP_001057.1__HsTNFRSF1B (opt12)
gggagagucccgcagucggcguccagcggcucugcuuguucgugugugugucguugcaggccuuauucaagcuuaccauggcuccuguagccguaugggcagcucuagccguaggauuagaauuaugggcugcugcccaugcacuaccugcccaaguugcuuuuacaccauacgcaccagaaccugguucaacauguagauuaagagaauauuaugaucaaacugcucaaauguguuguucaaaauguagcccuggucaacaugccaaaguauucuguacuaaaacuucugauaccguaugugauucaugugaggauucaacauauacacaauuauggaauuggguaccagaauguuuaucauguggaucucgauguucaucagaucaaguagaaacacaagcuuguacaagagaacaaaauagaauauguacuuguagaccagguugguacugcgccuuaucaaaacaagaaggauguagacuaugcgccccacuacgaaaauguagaccaggauuugguguugcacguccaggaacagaaacaucagacguaguauguaaaccaugcgcucccgguacauucucaaauacaacaucauccaccgauauaugucgaccacaucaaauauguaauguaguagcaauaccaggaaaugcaucuauggacgcaguauguacaucaacaucacccacaagaucaauggcaccaggugcuguccaucuaccacaaccuguuucaacaagaucacaacauacacaaccuacacccgaaccauccacagcaccaaguaccucauuucuuuuaccuaugggaccaucaccaccugcagaaggaucaacaggagauuuugcacuuccaguaggacuaauaguuggaguaacugcacuaggauuauuaauaauuggagucguaaauuguguaauaaugacacaaguaaaaaaaaaaccauuaugcuuacaacgagaagccaaagucccucauuuaccagcagacaaagcuagaggaacccaaggaccagaacaacaacaccuacucauaaccgcaccuucaucaucuucaucaucuuuagaaucaucugcaucugcauuagauagaagagcacccacaagaaaucaaccacaagcaccuggaguugaagcuuccggggcaggugaagcucgagcuucaacaggaucuucagauucaucuccagguggucauggaacccaaguuaauguaacuugcaucguaaauguauguucaucaucagaucacucaucacaauguucaucacaagcaaguucaacuaugggagauacugacucaagcccaucggaaucaccuaaagaugaacaaguaccauuuaguaaagaagaaugugcauuuagaucucaacuugaaacaccagaaacuuuauuaggaaguacagaagaaaaaccacuaccauuaggaguacccgaugcagggaugaaaccuuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7327 - RNA, 789 nt, Artificial Sequence
  mRNA product Design5 comprising derived and/or modified sequence from Homo sapiens__NP_002623.2__HsPGF (opt12)
gggagagucccgcagucggcguccagcggcucugcuuguucgugugugugucguugcaggccuuauucaagcuuaccaugccaguaaugaggcuauuuccauguuuuuuacaauuacuagcaggauuagcauuaccagcaguaccaccacaacaaugggcauuaagugcaggaaauggaaguucagaaguagaaguaguaccauuucaagaaguauggggaagaucauauuguagagcacuugaaagauuaguagauguaguaagugaauauccaagcgaaguagaacauauguuuucaccaucauguguaaguuuauuaagauguacaggauguuguggagaugaaaaucuacauuguguaccaguagaaacagcaaauguaacaaugcaauuacuaaaaauaagaaguggagauagaccaucauauguagaauuaacauucagucaacauguaagaugugaauguagaccauuaagagaaaaaaugaaaccagaaagaagaagaccaaaaggaagaggaaaaagaagaagagaaaaacaaagaccaacagauugccauuuauguggagaugcaguaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7328 - RNA, 1515 nt, Artificial Sequence
  mRNA product Design5 comprising derived and/or modified sequence from Homo sapiens__NP_001020537.2__HsVEGFA (opt12)
gggagagucccgcagucggcguccagcggcucugcuuguucgugugugugucguugcaggccuuauucaagcuuaccaugacagacagacaaacagauacagcaccuucaccaagcuaucacuuauuaccugguagaagaagaacaguagaugcagcagcuaguaggggacaaggaccagaaccagcuccaggaggagguguagaaggaguaggggcaagaggaguagcuuuaaaauuauuuguacaacuuuuaggauguagcagguuuggaggagcgguuguaagagccggugaagcagaaccgucaggagcagcaagaucagcaagcucaggaagggaagaaccacaaccagaagaaggugaagaagaagaagaaaaggaagaagaaaggggaccacaauggcgacugggagcaagaaagccagguaguuggacaggagaagcagcaguaugcgcagacucugcaccagcagcaagagcaccgcaagcauuagcucgagcaaguggaaggggaggaagaguagcucgaagaggagcagaagaaucaggaccuccacacaguccaaguaggagaggaagugcaagcagggcaggaccagggagagcaagcgaaacaaugaauuuucuauugaguuggguacauuggagccuagcccuauuauuauauuuacaucaugcuaaauggucacaagcagcaccaauggcagaaggaggaggacaaaaucaucaugagguagugaaauuuauggauguauaucaaagaucauauugucauccaauagaaacauuaguugacauauuucaagaauauccagaugaaauagaauauaucuuuaaaccuagcugugucccauugaugagauguggaggauguuguaaugaugagggauuagaaugcguaccaacagaagaaaguaacauaacaaugcaaauaaugcgaauaaaaccacaucaaggacaacauauaggagaaaugucauuuuugcaacauaacaaaugcgaaugcaggccaaaaaaagacagagcaagacaagaaaaaaaaaguguuagaggaaaaggaaaaggucaaaaaaggaaaagaaaaaaaaguagauauaaaaguuggaguguauauguaggagcaagauguuguuuaaugccauggagucuaccgggaccacauccauguggaccuugcagugagaggagaaaacacuuauuuguucaagacccacaaacauguaaauguucuuguaaaaacacugauagcagauguaaagcucgacaauuggaauuaaaugaaaggacauguagaugugauaaaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7329 - RNA, 975 nt, Artificial Sequence
  mRNA product Design5 comprising derived and/or modified sequence from Homo sapiens__NP_001165094.1__HsVEGFA (opt12)
gggagagucccgcagucggcguccagcggcucugcuuguucgugugugugucguugcaggccuuauucaagcuuaccaugaacuuccuauuaagcuggguacacuggucacuagcauuauuauuauauuuacaucacgccaaauggucacaagcagcaccaauggcagaaggaggaggacaaaaccaccacgaaguaguaaaauuuauggauguauaccaaagaagcuauugccauccaauagaaacacuaguagacauauuccaagaauauccagaugaaauagaauauauauuuaaaccauccugcguaccauuaaugagaugcggaggaugcugcaacgacgaaggacuagaaugcguaccaacagaagaaaguaauauaacaaugcaaauaaugagaauaaaaccacaccaaggacaacacauaggcgaaaugaguuucuuacaacauaacaaaugcgaaugcagaccaaaaaaagacagagcaagacaagaaaaaaaaagcguaagaggaaaaggaaaaggacaaaaaagaaaaagaaaaaaaagcagauacaaaagcuggagcguauacguaggagcaagaugcugcuuaaugccauggucacuaccaggaccacacccaugcggaccauguucagaaagaagaaaacaucuauuuguacaagacccacaaacauguaaaugcucaugcaaaaacaccgacaguagauguaaagcaagacaacuagaacuaaaugaaagaaccuguagaugugacaaaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7330 - RNA, 900 nt, Artificial Sequence
  mRNA product Design5 comprising derived and/or modified sequence from Homo sapiens__NP_003368.1__HsVEGFB (opt12)
gggagagucccgcagucggcguccagcggcucugcuuguucgugugugugucguugcaggccuuauucaagcuuaccaugucaccacuauuaagaagacuacuauuagcagcauuacuacaacuagcaccagcacaagcuccaguaagccaaccagacgcacccggacaucaaagaaaaguaguaucauggauagauguauacacaagagcaacaugucaaccaagagaaguuguagucccacuaacaguagaauuaaugggaacaguagcaaaacaauuaguaccaucaugcguaaccguacaaagaugcggaggauguugcccagacgauggcuuagaaugcguaccaacuggacaacaucaaguaagaaugcaaauacuaaugauaagauacccaucaucacaauuaggagaaaugucauuagaagaacauucacaaugcgaaugcagaccaaaaaaaaaagacucagcaguaaaaccagacagagcagcaacaccacaucauagaccacaaccaagaucaguaccaggaugggacucagcaccaggagcaccaucuccagcagacauaacacauccaacaccagcaccaggaccaucagcacaugcagcacccucaacaacaagugcacuaacaccaggaccagcagcagcagcagcugacgcagcagcaucaucagucgcaaaaggaggagccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7331 - RNA, 1536 nt, Artificial Sequence
  mRNA product Design5 comprising derived and/or modified sequence from Homo sapiens__NP_005420.1__HsVEGFC (opt12)
gggagagucccgcagucggcguccagcggcucugcuuguucgugugugugucguugcaggccuuauucaagcuuaccaugcaccuauuaggauucuuuagcguagcgugcaguuuauuggcagcagcacuauuaccagguccacgugaagcaccagccgcagccgcagcuuucgaaucaggauuagacuuaagcgacgcugaacccgacgcaggcgaagcaacagcauacgcuucaaaagaucuagaagaacaacuaagaucuguaucuucaguagacgaauuaaugacaguacuauacccagaauauuggaaaauguauaaaugccaacuaagaaaaggagguuggcaacacaauagagaacaagcaaacuuaaacuccagaacagaagagacuauaaaauuugcagcagcacauuacaacacagaaauucuaaaaucaauagacaaugaauggagaaaaacucaauguaugccaagagaaguaugcauagacguagguaaagaauucgguguagccaccaacacauuuuuuaaaccaccaugcguaucaguauauagaugcggaggcuguugcaauucagaaggauuacaauguaugaauaccucuacaagcuaccuaucaaaaacacuauucgaaauaacuguaccauuaucacaaggaccaaaaccaguaacaauaucauuugcaaaccacacaucaugucgaugcaugucaaaauuagacguauaccgacaaguacacaguauaauaagaagaucacuacccgcaacacuaccacaaugccaagcagcaaauaaaacaugcccaacuaacuacauguggaauaaucauauuuguagaugccuagcacaagaagauuucauguucucaagugaugcaggugacgacucuacugacggauuucaugacauauguggaccaaauaaagaacuagacgaagaaacaugucaaugcguaugcagagcaggacuucgaccagcauccugugguccacauaaagaacuagauagaaauucaugccaauguguuuguaaaaauaaauuauuccccagccaaugcggagcaaauagagaauuugaugaaaauacaugccaauguguauguaaaagaaccugcccaagaaaucaaccacuaaacccaggaaaaugcgccugcgaaugcacagaaaguccacaaaaaugucuauuaaaagguaaaaaauuccaucaccaaacauguucaugcuacagaagaccaugcacaaacagacaaaaagcaugugaaccuggauuuucauauucagaagaaguuuguagauguguuccaucauacuggaaacgaccacaaaugagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7332 - RNA, 1341 nt, Artificial Sequence
  mRNA product Design5 comprising derived and/or modified sequence from Homo sapiens__NP_004460.1__HsVEGFD (opt12)
gggagagucccgcagucggcguccagcggcucugcuuguucgugugugugucguugcaggccuuauucaagcuuaccauguacagagaauggguaguaguaaacguauucaugaugcuauauguacaacuuguacaaggaagcucaaaugaacacggaccaguaaaaagaucaucacaguccacacuagaaagaucagaacaacaaauaagagcagcauccucucuagaagaauuacuaagaaucacacauuccgaagacuggaaauuauggcgaugucgacuacgcuuaaaaagcuuuacuaguauggacucacgcucagcaucacauagaaguacaagauuugcagcaacauucuacgacauagaaacacuaaaaguaauagaugaagaauggcaaagaacacaaugcucaccaagagaaacaugcgucgaaguagcaucugaacucggaaaauccaccaauacauucuucaaaccaccaugcguuaacguauuuagaugcggaggauguugcaacgaagaaucacuaauaugcaugaauacauccacaucauacauaucaaaacaacuauucgaaauauccguaccauuaacaucaguaccagaacuaguaccaguaaaaguagcaaaucacacaggaugcaaaugccuaccaacagcaccaagacacccuuacagcauaauaagaagaucaauacaaauacccgaagaagacagaugcucccacagcaaaaaauuaugcccaaucgacaugcuaugggacucaaacaaaugcaaaugcguacuacaagaagaaaacccacuagcagguacagaagaccacucacaccuacaagaaccagcauuaugcgguccucacaugauguucgacgaagauagaugcgaaugcguaugcaaaacaccauguccaaaagacuuaauacaacacccaaaaaauugcuccuguuuugaauguaaagaaucacuagaaacaugcugccaaaaacacaaauuauuucaucccgauacaugcucaugcgaagacagaugcccauuccacacaagaccaugcgcaaguggaaaaacagccugcgccaagcacugccgauucccaaaagaaaaaagagcagcucaaggaccacacucacgaaaaaauccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7333 - RNA, 906 nt, Artificial Sequence
  mRNA product Design5 comprising derived and/or modified sequence from Homo sapiens__NP_061986.1__HsFGF21 (opt13)
gggagagucccgcagucggcguccagcggcucugcuuguucgugugugugucguugcaggccuuauucaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7334 - RNA, 1686 nt, Artificial Sequence
  mRNA product Design5 comprising derived and/or modified sequence from Homo sapiens__NP_002412.1__HsMMP1 (opt13)
gggagagucccgcagucggcguccagcggcucugcuuguucgugugugugucguugcaggccuuauucaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7335 - RNA, 1446 nt, Artificial Sequence
  mRNA product Design5 comprising derived and/or modified sequence from Homo sapiens__NP_002412.1__HsMMP1(1-19,100-469) (opt13)
gggagagucccgcagucggcguccagcggcucugcuuguucgugugugugucguugcaggccuuauucaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7336 - RNA, 3633 nt, Artificial Sequence
  mRNA product Design5 comprising derived and/or modified sequence from Clostridium histolyticum__BAA77453.1__ColG (opt13)
gggagagucccgcagucggcguccagcggcucugcuuguucgugugugugucguugcaggccuuauucaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7337 - RNA, 3357 nt, Artificial Sequence
  mRNA product Design5 comprising derived and/or modified sequence from Clostridium histolyticum__BAA77453.1__HsALB(1-18)_ColG(111-1118) (opt13)
gggagagucccgcagucggcguccagcggcucugcuuguucgugugugugucguugcaggccuuauucaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7338 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt13)
gggagagucccgcagucggcguccagcggcucugcuuguucgugugugugucguugcaggccuuauucaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7339 - RNA, 3381 nt, Artificial Sequence
  mRNA product Design5 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7340 - RNA, 3342 nt, Artificial Sequence
  mRNA product Design5 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7341 - RNA, 3276 nt, Artificial Sequence
  mRNA product Design5 comprising derived and/or modified sequence from Clostridium histolyticum__BAA34542.1__HsALB(1-18)_ColH(41-1021) (opt13)
gggagagucccgcagucggcguccagcggcucugcuuguucgugugugugucguugcaggccuuauucaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7342 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt13)
gggagagucccgcagucggcguccagcggcucugcuuguucgugugugugucguugcaggccuuauucaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7343 - RNA, 852 nt, Artificial Sequence
  mRNA product Design5 comprising derived and/or modified sequence from Homo sapiens__NP_001133.1__HsAMELX (opt13)
gggagagucccgcagucggcguccagcggcucugcuuguucgugugugugucguugcaggccuuauucaagcuuaccaugggaacauggauauuauucgcaugccuacuaggagcagcauucgcaaugccacuaccaccacacccaggacacccaggauacauaaacuucucauacgaaguacuaacaccacuaaaaugguaccaaucaauacgacccccauacccaucauacggauaugaacccaugggaggauggcuacaccaccaaauaauaccaguacuaucacaacaacaucccccaacacacacauuacaaccucaccaccacauaccaguaguaccagcacaacaaccaguaauaccacaacaaccaaugaugccaguaccaggacaacacucaaugacaccaauacaacaccaccaaccaaaccuaccaccaccagcccaacaaccauaccaaccacaaccaguacaaccacaaccacaccaaccaaugcaaccacaaccaccaguacacccaaugcaaccacuaccaccacaaccaccacuaccaccaauguucccaaugcaaccacuaccaccaaugcuaccagaccuaacacucgaagcauggccaucaaccgauaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7344 - RNA, 411 nt, Artificial Sequence; identical to SEQ ID NO: 6792
  mRNA product Design5 comprising derived and/or modified sequence from Homo sapiens__NP_001133.1__HsAMELX-TRAP (opt13)

SEQ ID NO: 7345 - RNA, 444 nt, Artificial Sequence; identical to SEQ ID NO: 6793
  mRNA product Design5 comprising derived and/or modified sequence from Homo sapiens__NP_001133.1__HsAMELX-LRAP (opt13)

SEQ ID NO: 7346 - RNA, 483 nt, Artificial Sequence; identical to SEQ ID NO: 6794
  mRNA product Design5 comprising derived and/or modified sequence from Homo sapiens__NP_001133.1__HLA-A2-SP_HsAMELX(17-60) (opt13)

SEQ ID NO: 7347 - RNA, 516 nt, Artificial Sequence; identical to SEQ ID NO: 7255
  mRNA product Design5 comprising derived and/or modified sequence from Homo sapiens__NP_001133.1__HLA-A2-SP_HsAMELX(17-47,168-191) (opt13)

SEQ ID NO: 7348 - RNA, 855 nt, Artificial Sequence
  mRNA product Design5 comprising derived and/or modified sequence from Homo sapiens__NP_001134.1__HsAMELY (opt13)
gggagagucccgcagucggcguccagcggcucugcuuguucgugugugugucguugcaggccuuauucaagcuuaccaugggaacauggauacuauucgcaugccuaguaggagccgcauucgcaaugccacuaccaccacauccaggacacccaggauauauaaacuucucauacgaaguauuaacaccacucaaaugguaccaauccaugauaagacccccauacucaucauacggauacgaaccaaugggcggauggcuacaccaccaaauaaucccaguaguaucccaacaacacccacuaacacacacauuacaaucacaccaccacauaccaguaguaccagcacaacaaccaagaguaagacaacaagcauuaaugccaguaccaggacaacaaucaaugacaccaacacaacaccaccaaccaaaccuaccacuaccagcacaacaacccuuccaaccucaaccaguacaaccacaaccacaccaaccaaugcaaccacaaccaccaguacaaccaaugcaaccacuauuaccacaaccaccacuaccacccauguucccacuaagaccauuaccaccaauacuaccagaccuacaccuagaagccuggccagcaacagacaaaacaaaacaagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7349 - RNA, 414 nt, Artificial Sequence; identical to SEQ ID NO: 6797
  mRNA product Design5 comprising derived and/or modified sequence from Homo sapiens__NP_001134.1__HsAMELY-TRAP (opt13)

SEQ ID NO: 7350 - RNA, 447 nt, Artificial Sequence; identical to SEQ ID NO: 7258
  mRNA product Design5 comprising derived and/or modified sequence from Homo sapiens__NP_001134.1__HsAMELY-LRAP (opt13)

SEQ ID NO: 7351 - RNA, 486 nt, Artificial Sequence
  mRNA product Design5 comprising derived and/or modified sequence from Homo sapiens__NP_001134.1__HLA-A2-SP_HsAMELY(17-61) (opt13)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauauauaaauuucucauacgaaguacuaacaccacuaaaaugguaucaaucaaugauaagaccaccauacucaucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7352 - RNA, 519 nt, Artificial Sequence
  mRNA product Design5 comprising derived and/or modified sequence from Homo sapiens__NP_001134.1__HLA-A2-SP_HsAMELY(17-48,169-192) (opt13)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7353 - RNA, 846 nt, Artificial Sequence
  mRNA product Design5 comprising derived and/or modified sequence from Sus scrofa__NP_999071.1__SsAMELX-001-1 (opt13)
gggagagucccgcagucggcguccagcggcucugcuuguucgugugugugucguugcaggccuuauucaagcuuaccaugggaacauggauacuauucgcaugccuacuaggagcagcauucucaaugccacuaccaccacacccaggacauccaggauacauaaacuucucauacgaaguacucacaccauuaaaaugguaccaaaacaugauaagacacccauacacaucauacggauacgaaccaaugggcggauggcuacaccaccaaauaauaccaguaguaucacaacaaaccccacaaucacacgcauuacaaccacaccaccauauaccaaugguaccagcacaacaaccaggaauaccacaacaaccaaugaugccacuaccaggacaacacucaaugacaccaacccaacaccaccaaccaaaccuaccccuacccgcacaacaaccauuccaaccacaaccaguacaaccccaaccacaccaacccuuacaaccacaaucaccaaugcacccaauacaaccacuacucccacaaccaccacuaccaccaauguucucaaugcaaucacuacuaccagaccuaccauuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7354 - RNA, 414 nt, Artificial Sequence; identical to SEQ ID NO: 6802
  mRNA product Design5 comprising derived and/or modified sequence from Sus scrofa__NP_999071.1__SsAMELX-TRAP (opt13)

SEQ ID NO: 7355 - RNA, 447 nt, Artificial Sequence
  mRNA product Design5 comprising derived and/or modified sequence from Sus scrofa__NP_999071.1__SsAMELX-LRAP (opt13)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaacaugauaagacacccaucacuacuaccagaccuaccauuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7356 - RNA, 486 nt, Artificial Sequence; identical to SEQ ID NO: 6804
  mRNA product Design5 comprising derived and/or modified sequence from Sus scrofa__NP_999071.1__HLA-A2-SP_SsAMEL(17-61) (opt13)

SEQ ID NO: 7357 - RNA, 519 nt, Artificial Sequence
  mRNA product Design5 comprising derived and/or modified sequence from Sus scrofa__NP_999071.1__HLA-A2-SP_SsAMEL(17-49,167-189) (opt13)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7358 - RNA, 810 nt, Artificial Sequence
  mRNA product Design5 comprising derived and/or modified sequence from Sus scrofa__P45561-2__SsAMELX-001-2 (opt13)
gggagagucccgcagucggcguccagcggcucugcuuguucgugugugugucguugcaggccuuauucaagcuuaccaugggaacauggauacuauucgcaugccuauuaggagcagcauucucaaugccacuaccaccacacccaggacacccaggauauauaaacuucucauacauaagacacccauacacaucauacggauacgaaccaaugggaggauggcuacaccaccaaauaauuccaguaguaucacaacaaacaccacaaucacacgcacuacaaccacaccaccacauaccaaugguaccagcacaacaaccaggaauaccacaacaaccaaugaugccacuacccggacaacacucaaugacacccacacaacaccaccaaccaaaccuaccacuaccagcacaacaaccauuccaaccacaaccaguacaaccacaaccacaccaaccauuacaaccacaaucaccaaugcacccaauacaaccacuacuaccacaaccaccacuaccacccauguucucaaugcaaucacuacuaccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7359 - RNA, 846 nt, Artificial Sequence
  mRNA product Design5 comprising derived and/or modified sequence from Sus scrofa__NP_998965.1__SsAMELX-001-3 (opt13)
gggagagucccgcagucggcguccagcggcucugcuuguucgugugugugucguugcaggccuuauucaagcuuaccaugggaacauggauauucuucgcaugccuauuaggagcaucccuagcaaugccacuaccaccacacccaggacacccaggauacauaaacuucucauacgaaguacucacaccauuaaaaugguaccaaaacaugauaagacacccauacacaucauacggauacgaaccaaugggaggcuggcuacaccaccaaauaauaccaguaguaucacaacaaacaccacaaucacacgcacuacaaccacaucaccacauaccaaugguaccagcccaacaaccaggaauaccacaacaaccaaugaugccacuaccaggacaacacucaaugacaccaacacaacaccaccaaccaaaccuaccacuaccagcacaacaaccauuccaaccacaaccaguacaaccacaaccccaccaaccacuacaaccacaaucaccaaugcacccaauccaaccacuacuaccacaaccaccacuaccaccaauguucucaaugcaaucccuacuacccgaccuaccacuagaagccuggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7360 - RNA, 495 nt, Artificial Sequence; identical to SEQ ID NO: 6808
  mRNA product Design5 comprising derived and/or modified sequence from Sus scrofa__K7GPB2__SsAMELX-002 (opt13)

SEQ ID NO: 7361 - RNA, 888 nt, Artificial Sequence
  mRNA product Design5 comprising derived and/or modified sequence from Sus scrofa__K7GLD0__SsAMELX-003 (opt13)
gggagagucccgcagucggcguccagcggcucugcuuguucgugugugugucguugcaggccuuauucaagcuuaccaugggaacauggauacuauucgcaugccuauuaggagcagcauucucaaugccacuaccaccacacccaggacacccaggauacauaaacuucucauacgaagaccuauacuuagaagcaauaagaauagacagaacagcauucguacuaacaccacuaaaaugguaccaaaacaugauaagacacccauacacaucauacggcuacgaaccaaugggaggauggcuacaccaccaaauaauaccagucguaucccaacaaacaccccaaucacacgcauuacaaccacaccaccacauaccaauggucccagcacaacaaccagguauaccccaacaaccaaugaugccacuaccaggacaacacucaaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccacaaccaccauuaccacccauguucucaaugcaaucacuauuacccgaccuuccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7362 - RNA, 774 nt, Artificial Sequence
  mRNA product Design5 comprising derived and/or modified sequence from Sus scrofa__K7GPE9__SsAMELX-004 (opt13)
gggagagucccgcagucggcguccagcggcucugcuuguucgugugugugucguugcaggccuuauucaagcuuaccaugggaacauggauacucuucgcaugccuacuaggcgcagcauucuccaugccacuaccaccacacccaggacaccccggauacauaaacuucucauacgaaguacucacaccacuaaaaugguaccaaaacaugauaagacacccaacaccacaaucacacgcacuacaaccacaccaccacauaccaaugguaccugcacaacaaccaggaauaccacaacaaccaaugaugccacuaccaggccaacacuccaugacacccacacaacaccaccaaccaaaccuaccacuaccagcccaacaaccauuccaaccacaacccguacaaccacaaccacaccaaccauuacaaccccaaucaccaaugcacccaauacaaccacuacucccacaaccaccacuaccaccaauguucucaaugcaaucacuacuaccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7363 - RNA, 798 nt, Artificial Sequence
  mRNA product Design5 comprising derived and/or modified sequence from Sus scrofa__J9JIM4__SsAMELX-201 (opt13)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaacaugauaagacaccccuacacaucauacggauacgaaccaaugggaggauggcuacaccaccaaauaauaccaguaguaucacaacaaacaccacaaucacacgcacuacaaccacaccaccacauaccaaugguaccagcccaacaaccaggcauaccacaacaaccaaugaugccacuaccaggacaacacucaaugacaccaacacaacaccaccaaccaaaccuaccacuaccagcacaacaaccauuccaaccacaaccaguacaaccacaaccacaccaaccacuccaaccacaaucacccaugcaccccauacaaccauuacuaccacaaccaccacucccaccaauguucuccaugcaaucacuacuaccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7364 - RNA, 3237 nt, Artificial Sequence
  mRNA product Design5 comprising derived and/or modified sequence from Homo sapiens__NP_006120.1__HsBMP1 (opt13)
gggagagucccgcagucggcguccagcggcucugcuuguucgugugugugucguugcaggccuuauucaagcuuaccaugccagguguagcacgucuaccauuauugcuagguuuauugcuacuaccccgaccgggacgaccacuagacuuagccgauuacacauaugaccuagcagaagaggacgauagugaaccauuaaacuacaaagauccauguaaagcugccgcauucuuaggugauauagcuuuagacgaagaagauuuacgugcauuucaaguccagcaagcaguagauuuacguagacauacugcacgcaaaaguucaauaaaagcagcuguaccaggaaacacaucaacaccuuccugucaaucaacaaauggucaaccucaaagaggggcuugcggacguuggagggggagaaguagaaguagacgugcagcaacaagucgaccagaacgaguauggccagauggaguaauuccauuuguaauugguggaaacuuuacuggaucacaaagagcuguauucaggcaagcuaugagacauugggaaaaacauacuugcguuacauucuuagaacgaacagaugaagauuccuauauaguauuuacuuauagaccuugugggugcuguaguuauguggguagaagaggggguggaccacaagcaauaucaauugguaaaaauugugacaaauuuggaauaguuguacaugaacuaggacauguaguaggauuuuggcacgaacauacaagaccagauagagacagacauguauccauaguuagagaaaauauacaaccaggacaagaauauaauuuccuaaaaauggagccacaggaaguagagaguuugggagaaacuuacgacuucgacaguauaaugcauuaugcaagaaauacuuuuucacgaggaauauuccuagauacuauugugccuaaauacgaagugaaugguguaaaaccuccaauuggucaaaggacuagguuaagcaaaggagauauagcacaagcgcgcaaacuuuauaaauguccagcauguggugaaacauuacaggacucaacaggaaauuuuucaucaccugaauacccuaacggguauagugcacauaugcacuguguauggagaauaucaguaacaccaggagagaaaauaauauuaaacuucacuagccuggaucuuuauagaucgagacucuguugguaugauuauguagaaguuagagauggcuucuggagaaaagcaccauugagagggcguuuuuguggcaguaaacuaccagaaccaauaguaucuacagauuccagauuaugggucgaguucagaaguucauccaauuggguaggaaaagguuucuucgccguauaugaagcgauaugcggaggggauguaaagaaagacuauggucauauacaaagcccuaauuauccugaugacuauaggccaaguaaaguuuguauuuggagaauacaagugucagaagguuuucacguuggacucacauuucaaucuuuugaaauagagcgccaugacucaugugcguaugacuauuuagagguaagagacggacauucagaaucuucuacucuuauaggaagauauuguggauaugagaaaccagaugauauaaaaaguacaaguucucgacuaugguuaaaauuuguaagcgauggaagcauaaauaaagcaggauuugcaguaaauuucuuuaaagaaguugaugaaugcucgagaccuaauagagggggaugcgaacaacgaugucuaaauacacucggaagcuacaaauguagcugugauccaggauaugaacuugcaccggacaaaagaagaugugaagcugcaugcggcggauuucuaaccaaacucaauggaucaauuacuuccccaggauggccuaaagaauauccaccgaauaaaaacugcauauggcaauuaguagcuccaacacaauaucgcaucagcuuacaauuugacuucuuugaaacugagggaaaugauguuuguaaauaugacuuugucgaagucagaucaggccucacagcagauucuaaauuacacggcaaauuuuguggaagcgaaaaaccggaaguaauaacaucacaauacaauaacaugagaguagaguuuaaaagcgauaauacaguaaguaagaaaggauuuaaagcacacuucuucucagauaaagacgaauguucaaaagacaaugggggaugucaacaagacuguguaaauacguuuggaucauaugaaugucaaugccgaaguggauucguacuucaugauaauaaacaugauuguaaagaagcagguugcgaucacaaaguuacaucaacuucaggcacaauaacuucaccuaacuggccagauaaauauccaucaaagaaagaauguacaugggcaauaucuucaaccccaggucaucgcguaaaauuaacauuuauggaaauggauauugaaucacaaccagaaugugcauaugaucacuuagaaguauucgacggaagggaugcaaaagcaccaguauuagguagauuuuguggcaguaagaaaccagaaccaguucuugcgacaggaagccguauguuuuuaagauuuuacucagauaauuccguacaaagaaaaggauuucaagccucccaugcgacggaauguggaggacaaguacgagcagauguuaaaaccaaagaccuauacucacacgcacaauuuggugauaauaauuacccaggugggguagacugcgaauggguaauaguagcagaagaaggguacggaguugaauuaguauuccaaacauuugaaguagaagaagaaaccgauuguggcuaugauuauauggaacuauucgacggauacgacuccacagcaccgagauuaggacgauacuguggaaguggaccaccagaagaaguuuauucagcaggagacucagucuuagugaaauuucauucggacgacacaauaaccaagaaaggauuccacuuaagauacacuucaacuaaauuccaagauacacuacacaguagaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7365 - RNA, 1467 nt, Artificial Sequence
  mRNA product Design5 comprising derived and/or modified sequence from Homo sapiens__NP_001191.1__HsBMP2 (opt13)
gggagagucccgcagucggcguccagcggcucugcuuguucgugugugugucguugcaggccuuauucaagcuuaccauggucgccggaaccagaugccuauuagcccuacuauuaccacaaguucuacuagguggagcugcaggauuaguaccagaacuaggaagacgaaaauucgcggcagcauccucaggaagaccaucaucacagccaucagacgaaguacuauccgaauucgaacuaagguuauuaucuauguuuggauuaaaacaaagaccaacgccaucuagagacgcagucguuccaccauacaugcuagaucuauauagaagacacuccggacaaccaggauccccagcacccgaucauagauuagaacgagccgcaucacgugcaaacaccguaagauccuuccaccacgaagaaucucuagaagaacuaccagaaacaucaggaaaaacuacaagaagauucuucuuuaaccuaucaucuaucccaacagaagaauucaucacaucagcagaauuacaagucuuuagagaacaaaugcaagacgcauuaggaaauaacucaucauuucaccacagaauuaacauauacgaaauaaucaaaccagcaaccgcaaacagcaaauucccagucacucgauuacuagauacaagacuaguuaaccaaaacgcaucaagaugggaaucauuugacguaacucccgcaguuaugagauggacagcacaaggacacgcaaaucacggauuugucguugaaguagcccauuuagaagaaaaacaaggaguuucaaaaagacacguccgcauaagcagaucacuacaucaagacgaacauucuuggagucaaauaagaccacuacuuguaacauucggccacgacggaaaaggacacccauuacacaaaagagaaaaaagacaagcaaaacacaaacaaagaaaaagacuaaaaucaucaugcaaaagacauccauuauacguagauuucucagauguaggauggaacgacuggauaguagcaccaccaggauaccacgcauuuuacugccauggagaaugcccauuuccacuagcagaccaccucaacucaaccaaccacgcaauaguucaaacccuaguaaauucaguaaauucaaaaauaccaaaagcaugcugugucccaacagaacuuucugcaauaucaaugcuauauuuagaugaaaacgaaaaaguaguucuaaaaaauuaccaagacauggucguagaaggaugcggauguagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7366 - RNA, 1503 nt, Artificial Sequence
  mRNA product Design5 comprising derived and/or modified sequence from Homo sapiens__NP_001193.2__HsBMP4 (opt13)
gggagagucccgcagucggcguccagcggcucugcuuguucgugugugugucguugcaggccuuauucaagcuuaccaugauaccaggaaauagaaugcucaugguaguauuauuaugccaaguacuucuagguggagcuucacaugcaucacuuauaccagaaaccggaaaaaaaaaaguagcagaaauacaaggacaugccggaggaagaagauccggacaaucacaugaauuacuacgagauuuugaggccacuuuauuacagauguucggauuaagaagacgaccucaaccaucaaaaucagcaguaauuccagacuacaugcgagaucuauacagauuacaaucaggagaagaagaagaagaacaaauacacaguaccggacuagaauacccagaaagaccagcaucaagagccaauaccguuagaucauuccaccaugaagaacauuuagaaaauauaccaggaacaucagaaaauucagcuuucagauuuuuauucaauuuaagcagcauaccagaaaacgaagucauaucaucagcagaacuaagacuauuuagagaacaaguugaccaaggaccugacugggaacgcggauuccacagaauaaauauauacgaaguaaugaaaccaccugcugaaguaguaccaggacaccuaauaacuagauuacuagauacaagacuaguacaccauaauguaacaaggugggaaacauuugacguaucaccggcaguauuacgguggacaagagaaaaacaaccaaauuacggacuagcaauagaagucacacacuuacaucaaacaagaacacaucagggucaacacguaagaauaucacgaucacuuccacaagguucagguaacugggcccaauuaagaccauuacuaguaacauuuggacaugacggaagaggacacgccuuaacacgaaggcgaagagccaaaagaaguccaaaacaccauucacaaagagcacgaaaaaaaaacaaaaauugccgaagacauucacuauacguagacuuuucagaugucggauggaaugacuggaucguagcaccaccaggcuaccaagcauuuuacugucacggagauugcccauuuccacuagcagaucacuuaaacucaaccaaucacgcaauaguacaaacacuaguaaauucuguaaacagcucuauaccaaaagcuuguuguguaccaacagaacuaucagccauaucuauguuauaucuagaugaauaugauaaaguaguauuaaaaaacuaucaagaaauggucguagaaggaugcggauguagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7367 - RNA, 1818 nt, Artificial Sequence
  mRNA product Design5 comprising derived and/or modified sequence from Homo sapiens__NP_001709.1__HsBMP6 (opt13)
gggagagucccgcagucggcguccagcggcucugcuuguucgugugugugucguugcaggccuuauucaagcuuaccaugcccggauuaggaagacgagcacaauggcuaugcugguggugggguuuauuauguagcuguugcgguccaccaccuuuaagaccaccauuaccagccgcagcugcugcugcagcaggcggucaacuauuaggagaugggggaucacccgggagaacagaacaacccccaccaucaccccaaagcucaucaggguucuuauacagaagauuaaaaacacaagaaaaacgcgaaaugcaaaaagaaauacuaaguguauuaggauugccacauagaccuagaccauuacauggauuacaacaaccacaaccuccagcuuuaagacaacaagaagaacaacaacaacaacaacaauuacccagaggagaaccacccccaggaagacuaaaaucugcuccauuauucaugcuagaccuauacaaugcacuaagcgcagacaaugacgaagauggagcuucugaaggagaaagacaacaaucauggccucaugaagcagcuucaagcagucaaaggagacaaccaccaccaggagcagcacacccacuuaaucgaaaaagccuacuagcacccggcucuggaucaggaggcgcaaguccauuaacaucagcacaagauagcgcguuuuuaaaugacgcagacaugguaaugucauucgugaauuuaguagaauacgauaaagaauuuucuccaagacaaagacaccacaaagaguucaaauucaaucuaucccaaauaccugaaggagaaguaguaacugcagcagaauuuagaaucuacaaagacuguguaaugggaucauucaaaaaucaaacuuucuuaauaucuaucuaccaaguauuacaagaacaucaacauagagacucugauuuauuccucuuagacacaagaguuguaugggcaucagaagaagguuggcuagaauuugacauuacugcaacaucaaacuuauggguaguaacaccacaacauaacaugggacuacaauuaucagucguaaccagagaugguguucauguacacccuagagcugcaggacuuguaggcagagacggaccauacgauaaacaaccauucaugguagcauucuucaaaguaucagaaguacauguaagaacaacacgaucugcuagcucaagaagaagacaacaaagucgcaacagaucuacacaaucacaagauguagcacgaguaucaucugcuucagacuauaacuccuccgaacuaaaaacagcaugcaggaaacacgaauuauacguuuccuuccaagauuuaggauggcaagacuggauaauagcacccaaaggauacgcugcaaacuacugcgacggugaauguucauuuccauuaaaugcacauaugaacgcaacaaaccaugcaaucguacaaacucuaguacaccuaaugaauccagaauauguccccaaaccauguugcgcacccacaaaacuuaacgcaauaucagucuuauacuuugacgacaauucaaauguaauccuaaagaaauauagaaacaugguagucagagccugcgguugccauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7368 - RNA, 1572 nt, Artificial Sequence
  mRNA product Design5 comprising derived and/or modified sequence from Homo sapiens__NP_001710.1__HsBMP7 (opt13)
gggagagucccgcagucggcguccagcggcucugcuuguucgugugugugucguugcaggccuuauucaagcuuaccaugcauguaagaucacuaagagcagcugccccacacucauuuguagcacugugggcaccacuuuuuuuacuaagaagcgcauuagcagacuuuucacuagacaaugaaguacauucaagcuuuauucauaggagacuucggucacaagaaagacgugaaaugcaaagagaaauauuaucuauucuaggacuaccacaccgcccaagaccacaucuacaaggaaaacacaauucagcuccaauguucaugcuagaucuuuauaacgcaauggcagucgaagaaggaggaggccccggaggacaaggauuuuccuauccauauaaagcaguauuuucaacacaaggaccuccucuagcaagucuacaagauucacauuucuuaacagaugcagauaugguaaugucauuuguaaauuuaguagaacaugauaaagaauuuuuucacccacguuaccaccauagagaauucagauucgaucuaucuaaaauaccagaaggugaagcaguaacagcagcugaauucagaauauacaaagauuacauacgagaaagauuugacaacgaaacauucagaauaucaguauaucaaguacuacaagaacacuuagguagagaaagcgaucuauuucuauuagacuccagaacacucugggcaucagaagaaggcuggcuaguauucgauauaacagcaaccaguaaucacugggucguaaacccaagacacaaccucggacuacaauuaucaguagaaacauuagacggccaaaguauuaacccaaaacucgcaggacuaauaggaagacacggaccacaaaacaaacaaccauucaugguagcauucuuuaaagcaaccgaaguacacuucagaucaauacgaucaacaggauccaaacaaagaagccaaaauagaucaaaaacuccaaaaaaucaagaagcauuaagaauggcaaauguagcugaaaauucaucaagugaucaaagacaagccugcaaaaaacacgaauuauacguauccuuccgagauuuaggauggcaagacuggauaauagcaccugaaggcuacgccgcauacuacugugaaggagaaugugcauuucccuuaaacucauauaugaacgcaacuaaucacgcuauaguacaaacacuaguacacuuuauaaaucccgaaacaguacccaaaccaugcugcgcaccaacacaacucaacgcuauaucaguauuauauuuugacgacucuucuaacguuauccuaaaaaaauaucgaaauaugguagucagagcauguggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7369 - RNA, 576 nt, Artificial Sequence; identical to SEQ ID NO: 6817
  mRNA product Design5 comprising derived and/or modified sequence from Homo sapiens__NP_006264.2__HsCCL7 (opt13)

SEQ ID NO: 7370 - RNA, 3900 nt, Artificial Sequence
  mRNA product Design5 comprising derived and/or modified sequence from Homo sapiens__NP_001954.2__HsEGF (opt13)
gggagagucccgcagucggcguccagcggcucugcuuguucgugugugugucguugcaggccuuauucaagcuuaccauguugcuuacuuuaauaauauuacuuccaguugucaguaaauuuucguuugugucauuaucugcaccacaacauuggaguuguccagaagguacgcuagcaggcaacgguaauucuacgugugucgguccagcgccauuucuaaucuuuucucaugguaacuccauuuuuagaauagauacagaagguacaaauuacgaacaauuaguaguugacgcaggagucagcguaauaauggacuuucauuauaaugagaaaagaaucuauuggguagacuuggaaagacaauuacuucagcguguauucuugaauggauccagacaagaaagaguauguaauauagagaaaaauguaucagguauggcuauaaacuggauaaaugaagaagugauuuggucaaaucaacaagaagggaucauuaccguuacagacaugaaaggaaauaauucccacauacuacuaucagcacuaaaauaucccgccaauguugcaguagauccaguggaaagauuuauauuuugguccucagaaguagcaggaucauuauauagagcagacuuagacgguguggguguuaaggcuuuacuagaaacuucugagaaaauuaccgcaguaaguuuagacguuuuagacaaaagauuauuuuggauucaauauaauagggaagguucaaauucacuuauauguucuugcgacuaugaugguggaucagugcauauaaguaaacauccaacgcaacacaaucucuuugcaaugucuuuauuuggugauagaauauuuuacagcacuuggaaaaugaaaacaauauggauagccaacaaacauaccggaaaagauaugguaaggauaaaucuacacaguuccuucguuccuuuaggugaacuaaaaguaguacauccacuagcgcaaccuaaagcggaagaugacacuugggaaccagaacaaaaacuauguaaguuacgaaaaggcaacuguucaucuacagugugcgggcaagacuuacaaagucacuuauguaugugcgcggaaggcuaugcgcucaguagagauagaaaauauugugaagauguaaaugaaugugcauuuuggaaccauggauguacacuaggaugcaaaaauacaccagguucauauuauuguacuugucccguuggauuuguccuguuaccagacggcaaaaggugccaucagcuaguaaguuguccacguaauguuucagaauguagccacgauuguguuuugacaagugaaggaccacuaugcuuuugcccagaaggaucaguauuagaaagggauggaaaaacauguagugguuguaguucaccagauaauggagguuguagucaacuuuguguuccauuaucuccuguaucuugggaaugcgauuguuucccagguuaugauuuacaauuagaugagaaaaguugugcagcgucuggcccacaaccauucuuacucuuugcaaauucacaagauauaagacacaugcauuucgauggcaccgacuacggcacccuauuaagucaacaaauggggaugguauaugcacuugaccaugauccaguagaaaacaaaauauacuucgcacauaccgcacucaaauggaucgaaagagcaaauauggacggaagucaaagggaacgguugauugaagaaggaguagauguaccugaggguuuagcaguugauuggauagggaggagauuuuauuggacggacagggggaaaaguuuaauaggacgaagcgaccucaacgggaaaagaagcaaaauaaucacuaaagaaaauauuucacaaccaagaggaauugcuguacauccaauggcaaaacgucuauuuuggacagacacaggaauaaauccuagaauagaguccaguucacugcaaggauuggggagauuagugaucgccaguuccgaccuaauauggccaucgggaauuacaauagacuuuuuaaccgauaaacuauauuggugcgaugcaaaacagucaguaauugaaauggccaaucuagauggaucuaaaagaagaagacuaacacaaaaugaugugggacacccauuugcuguugccguuuucgaggacuacgucugguuuucagauugggcaaugccaagugucaugagagucaauaagagaacugguaaggauagagucagauuacaaggcucaauguuaaaaccaucgagucuagucguaguccacccauuagcaaaaccaggugcagaucccugcuuauaucaaaauggagggugcgaacacauauguaagaaaagacuuggcacagcaugguguucauguagagaaggauuuaugaaggcuucagauggaaaaaccuguuuagcauuagauggccaucaacuucucgccggaggagaaguugacuugaaaaaccaaguaacaccccuagauauauuaagcaaaacaagaguuagcgaagauaacauaacagaaucucaacauauguuaguagcagaaauuauggucucagaucaagaugacugcgcaccuguaggauguucuauguaugcuagaugcauaucagagggggaagaugcgacaugucaaugcuuaaaaggauuugcaggcgacggaaaauuaugcucagacauagacgaaugugaaaugggaguuccuguuuguccuccagcaucuuccaaauguauaaauaccgaaggugguuauguauguagauguagugaaggauaccaaggggacgguauccauuguuuagauauagaugaaugccaauugggagaacacuccuguggagagaacgcauccuguacaaauacugaaggagguuauacguguaugugcgcaggaaggcuuuccgaaccugguuuaauuugcccagauucaacaccucccccacaccuucgugaagaugaccaccauuauaguguacgaaauucagauucugagugcccacuaagccaugauggauauuguuuacacgauggaguaugcauguacauagaagcguuggauaaauacgcuuguaauugugugguuggauacauaggugaaagaugucaauaccgagaccuaaaauggugggaacuaagacaugccgggcacggacaacaacaaaaaguaauagucguugcaguguguguaguagucuuagucaugcuauuacuauugagccucuggggugcacacuauuauaggacacaaaaacuacuaucuaaaaaccccaaaaauccauaugaagaaucaagucgugaugucagaucaagaagaccagcagacacagaagacggaaugucaucguguccacaaccaugguuugugguaauuaaagaacaucaagaucucaaaaacggaggccaacccguugcuggugaagauggacaagcagcagaugguaguaugcagcccacaucauggcgacaagagccacaauuaugcggcaugggaacagaacaagguuguuggauuccaguuaguucugacaaaggaagcuguccgcaagugauggagaggucauuucauaugccaagcuacggaacacagacacucgaaggcggaguagagaaaccacauucgcuucuuucugcaaacccauuauggcaacaaagagcucuagauccaccucaccaaauggaauugacucaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7371 - RNA, 786 nt, Artificial Sequence
  mRNA product Design5 comprising derived and/or modified sequence from Homo sapiens__NP_001423.1__HsEREG (opt13)
gggagagucccgcagucggcguccagcggcucugcuuguucgugugugugucguugcaggccuuauucaagcuuaccaugacagcaggcagaagaauggaaaugcuaugugcaggacgaguaccagcauuauuacuaugucuaggauuccauuuauuacaagcaguacuaagcacaacaguaauaccaagcuguauaccaggagaaagcucagacaauugcacagccuuaguacaaacagaagacaauccaagaguagcacaaguaaguauaacaaaaugcucaagcgauaugaauggauauugcuuacacggacaauguauauaucuaguagacaugagccaaaacuauugcagaugcgaagucggauacacaggaguaagaugugaacauuucuucuuaacaguacaucaaccacuaucaaaagaauacguagcauuaacaguaauauuaauaauacuauuucuaauaacaguaguaggaagcacauacuauuucuguagaugguacagaaacagaaaaucgaaagaaccaaaaaaagaauacgaacgaguaacaucaggagauccagaacuaccacaaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7372 - RNA, 744 nt, Artificial Sequence
  mRNA product Design5 comprising derived and/or modified sequence from Homo sapiens__NP_000791.1__HsFGF1 (opt13)
gggagagucccgcagucggcguccagcggcucugcuuguucgugugugugucguugcaggccuuauucaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggcacaguagacggaacaagagacagauccgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaagcugcaaaagaggaccaagaacacacuacggacaaaaagccauacuauuccuaccacuaccaguaucaucagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7373 - RNA, 1143 nt, Artificial Sequence
  mRNA product Design5 comprising derived and/or modified sequence from Homo sapiens__NP_001997.5__HsFGF2 (opt13)
gggagagucccgcagucggcguccagcggcucugcuuguucgugugugugucguugcaggccuuauucaagcuuaccaugguaggaguaggagggggagauguagaagauguaacaccaagaccagguggaugucaaauuagcggaagaggugcaagaggauguaauggaauaccaggagcagcagcuugggaagcagcauuaccgagaagacgaccgagaagacauccgagugugaauccaagaucaagagcagcuggaagcccaagaacaagaggaagaagaacagaagaaagaccaaguggaagcagauuaggagauagaggaagaggacgagcauuaccaggaggaagauuaggaggaagaggaagaggaagagcaccagagagaguaggagggagaggaagaggaagaggaacagcagcgccaagagcagcaccagcagcaagaggaucaagaccaggaccagcaggaacaauggcagcgggaaguauaacaacauuaccagcucuaccagaagauggaggaaguggggcguuuccaccaggacauuuuaaagauccaaaaagauuauauuguaaaaauggaggauuuuuuuuaagaauacauccagauggaagaguagaugggguaagagaaaaaucagauccacauauaaaauuacaauuacaagcggaagaaagaggagugguaaguauuaaaggaguuugugcaaauagauauuuggcgaugaaagaagaugggagguuauuagcaaguaaauguguaacggaugaauguuuuuuuuuugaaagacuagaaagcaauaacuauaacacauauagaucgagaaaauacacaucaugguauguagcauuaaaaagaacaggacaauauaaacuaggaaguaaaacaggaccaggacaaaaagcaauauuauuuuuaccaaugagugcaaagaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7374 - RNA, 861 nt, Artificial Sequence
  mRNA product Design5 comprising derived and/or modified sequence from Homo sapiens__NP_002000.1__HsFGF7 (opt13)
gggagagucccgcagucggcguccagcggcucugcuuguucgugugugugucguugcaggccuuauucaagcuuaccaugcacaaauggauacuaacauggauacuaccaacacuacuauacagaagcugcuuccacauaauaugccuaguaggaacaauaucacuagcaugcaacgacaugacaccagaacaaauggcaacaaacguaaacugcucaucuccagaaagacacacaagaucauacgacuacauggaaggaggagacauaagaguaagaagacuauucugcagaacacaaugguaccuaagaauagacaaaagaggaaaaguaaaaggaacacaagaaaugaaaaacaacuacaacauaauggaaauaagaacaguagcaguaggaauaguagcaaucaaaggaguagaaucagaauucuaccuagcaaugaacaaagaaggcaaacuauacgcaaaaaaagaaugcaacgaagacugcaacuucaaagaacuaauacuagaaaaccacuacaacacauaugcaagcgcaaaauggacacacaacggaggagaaauguucguagcauuaaaccaaaaaggaauaccaguaagaggaaaaaaaacaaaaaaagaacaaaaaacagcacacuuccuaccaauggcaauaacauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7375 - RNA, 903 nt, Artificial Sequence
  mRNA product Design5 comprising derived and/or modified sequence from Homo sapiens__NP_001936.1__HsHBEGF (opt13)
gggagagucccgcagucggcguccagcggcucugcuuguucgugugugugucguugcaggccuuauucaagcuuaccaugaaauuauuaccaucaguaguacuaaaacuauuucuagcagcaguacuaucagcauuaguaacaggagaaagccuagaaagacuaagaagaggacuagcagcaggaaccucaaacccagacccaccaacaguaucaacagaucaauuacuaccacuaggcggaggaagagauagaaaaguaagagacuuacaagaagcagaccuagauuuacuaagaguaacauuaucaucaaaaccacaagcacuagcaacaccaaacaaagaagaacacggaaaaagaaaaaaaaaaggaaaaggauuaggaaaaaaacgagauccaugccuaagaaaauauaaagacuucugcauacauggagaaugcaaauacgucaaagaacucagagcaccaagcugcauaugucacccuggauaccacggagaaagaugccacggacuaagucuuccaguagaaaacagauuauacacauacgaccacacaacaauacuagcaguaguagcaguaguauuaagcucaguaugucuauuaguaauaguaggucuacuaauguucagauaucaccgaagaggaggauacgauguagaaaaugaagaaaaaguaaaacuaggaaugacaaauagccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7376 - RNA, 2463 nt, Artificial Sequence
  mRNA product Design5 comprising derived and/or modified sequence from Homo sapiens__NP_000592.3__HsHGF (opt13)
gggagagucccgcagucggcguccagcggcucugcuuguucgugugugugucguugcaggccuuauucaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7377 - RNA, 2202 nt, Artificial Sequence
  mRNA product Design5 comprising derived and/or modified sequence from Homo sapiens__NP_005336.3 __HsHSPA1A (opt13)
gggagagucccgcagucggcguccagcggcucugcuuguucgugugugugucguugcaggccuuauucaagcuuaccauggccaaagcagcugcaauaggaauagaucuaggaacaacauacuccuguguaggaguauuccaacacggaaaaguagaaauaaucgcaaaugaucaagguaacagaacaacaccaucauacguugcauuuacagacacagaaagauuaauaggagaugcagccaaaaaccaagucgcacuaaauccacaaaacacaguauuugaugcaaaacgcuuaauaggaagaaaauuuggcgauccaguaguacaaucagacaugaaacauuggccauuucagguaauaaacgauggagauaaaccaaaaguucaaguuaguuacaaaggcgaaacuaaagcauuuuacccggaagagauaucaagcaugguauuaacaaaaaugaaagaaaucgcagaggcuuauuuaggauacccaguaacaaacgcaguaauaacaguaccagcuuacuuuaaugauagucagagacaagcaacuaaagaugccggaguaauugccggacuaaacguacuaagaauaauaaacgaaccaacugcagcagcaauagcauauggauuagauagaacaggcaaaggagaaagaaauguauuaauauucgaccuaggaggagguacauucgacgugucaauauuaacaauugaugauggaauauucgaaguaaaagcaacagccggggacacacauuuagggggagaagauuuugacaacagacugguaaaccauuuuguagaagaauuuaaaagaaaacacaagaaagacauuucacaaaauaaaagggcaguuagaagacuaagaacugcaugugagagggcaaaaaggacguuaagcaguaguacccaagcaucacuagagauagacucauuauuugaaggaauugauuuuuauacuucaaucacgagagcgagauuugaagaauuauguagugaucucuuuagaucgacauuagaaccugucgaaaaagcacuaagagaugcgaaacuagacaaagcacaaauacaugacuuaguucuaguaggaggaucaaccagaauaccaaaaguacaaaaacuacuacaagauuucuucaacggaagggacuuaaauaaaucaauaaacccagaugaagcugucgcuuacggugcagcuguccaagcagcaauacuaaugggagauaaaagcgagaaugugcaagacuuauuauuauuagacguugcaccucuaucgcuaggacuagaaacagcaggaggaguaaugacagcacuuauaaaaagaaacagcacaauaccgacuaaacaaacgcaaauauuuacaaccuauucagauaaccaaccuggcguccuuauacagguuuaugaaggugaaagagcaaugacaaaagauaacaaucuacuaggaagauuugagcuaaguggaauaccaccagcaccucgaggaguaccacaaauagaaguuacauucgacauagacgcuaauggcauucuaaaugugacagcuacugacaaaaguaccggaaaagcaaauaaaauaacuauuacaaacgauaaaggaagacuaagcaaggaagagauagaacgcaugguacaggaagcagaaaaauacaaagcggaagacgagguccagcgagaaagaguaagcgcuaaaaacgcauuagaaucauaugcauucaacaugaaaagcgcaguagaagaugaaggacuaaaagguaaaauaagcgaagcagauaaaaagaaaguacuagauaaaugucaagaaguuauaaguugguuagaugcaaauacuuuagcggaaaaagaugaauuugaacauaaaagaaaagaacuagaacagguaugcaauccuauuauaucaggauuauaccaaggagcuggaggaccaggaccaggaggcuucggagcacaaggaccgaaaggaggauccggaucagggccaacaauagaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7378 - RNA, 2202 nt, Artificial Sequence
  mRNA product Design5 comprising derived and/or modified sequence from Homo sapiens__NP_005337.2 __HsHSPA1B (opt13)
gggagagucccgcagucggcguccagcggcucugcuuguucgugugugugucguugcaggccuuauucaagcuuaccauggcaaaagcugcagcaauaggaauagaccuaggaacaacauacuccugcguaggaguauuucagcaugguaaaguugaaauaauagcuaacgaccaaggcaacagaacaacccccucauacgucgcauucacagauaccgaaagauuaaucggagaugcggcuaaaaaccaaguggcacucaauccacaaaacacaguauuugacgcaaaaagacugauaggaagaaaauucggcgauccagugguucaaucagauaugaaacauuggccauuccagguaauaaaugauggagauaaaccaaaaguacaaguaucauauaaaggagaaacaaaagcauuuuauccagaggaaauaaguaguaugguauuaacaaaaaugaaagaaauagcugaagcauaucucggauacccaguaacaaacgccguaauaacaguuccagcauauuucaacgacagucaaagacaagcaacaaaagaugcaggaguaauagcuggccuaaauguacuuagaauaauaaaugaaccuacugcugcugccauagcauacggacuagaucgaacaggcaaaggagaaagaaauguuuuaauauucgaccuuggaggaggaacauucgacguaagcauuuuaacaauagaugauggaauauuugaaguuaaagccacugcaggggauacucaccuaggaggagaagauuucgauaacaggcuaguuaaucauuuuguagaagaauuuaaaagaaaacauaagaaagacauaagucaaaacaaaagagcaguaagaagauugagaacagcaugugaaagagcuaaaagaacgcuaagcucaagcacacaagcaaguuuagaaauagauaguuuauuugaaggaauagauuuuuauacuucgauaacgagagcaagauuugaagaauuauguucagauuuauuuagaucaacguuagaaccaguugaaaaagcacuaagagacgcaaaauuagauaaagcucaaauacaugaccuagucuuggucggaggcucaacacgaaucccuaaaguacaaaaauuacuucaagauuucuuuaacgguagagaucuaaauaaaucaauaaaucccgacgaagcuguagcauauggagcagcuguacaagccgcaauucuuaugggagauaaaucagaaaauguacaagauuugcuacuuuuagacguggcaccacuuagccuaggacuagaaacagcuggaggaguaaugaccgcauuaauaaaacgcaacucgacuauaccaacaaaacaaacacaaaucuuuacaacauacagugauaaucaaccaggaguacuaauacaaguauaugaaggagaaagagcaaugacuaaagacaauaaucuacuaggacgguucgaacuaagcggcauuccaccagcaccucgaggaguaccacaaauugaaguaacauuugauauagacgcaaacgggauauuaaacguuacagcaaccgauaaaagcacaggcaaagcaaacaaaauaacaauuacaaaugauaaaggaagacuuucaaaagaagaaauagagagaaugguacaagaagcugagaaauacaaagccgaagacgaaguccaaagagaaagaguuagcgcuaaaaacgcacuggaaucauaugcuuucaauaugaaaucagcaguagaggacgaaggacuaaaaggcaaaauuucagaagcagacaaaaagaaaguacuagauaaaugucaagaaguaauuagcugguuagaugcaaauacccuggcagagaaagaugaauuugaacauaaaagaaaagaauuagaacaaguaugcaaucccauaauaucaggucuguaucaaggagcaggcgggccaggaccaggaggauuuggagcacagggaccaaaagguggauccgguagcggcccaacaaucgaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7379 - RNA, 2202 nt, Artificial Sequence
  mRNA product Design5 comprising derived and/or modified sequence from Homo sapiens__NP_005518.3 __HsHSPA1L (opt13)
gggagagucccgcagucggcguccagcggcucugcuuguucgugugugugucguugcaggccuuauucaagcuuaccauggcaacagcaaaaggaauagcaauaggaauagacuuagggacaacuuacaguuguguuggaguauuucagcacgggaaagucgaaauaauagcaaacgaucaagguaauaggaccaccccuucguacguagcauuuacagauacugaaagacuaauaggugaugcagcgaaaaaccaagucgcaaugaacccgcaaaauacaguauuugacgcaaaacgguuaauuggaagaaaguuuaacgacccaguuguacaagcagauaugaaauuauggccauuccaaguaauaaacgaaggaggaaaaccuaaaguguugguauccuauaaaggcgaaaacaaagcauuuuauccggaagaaauaucaucaaugguacuaacaaaacuuaaagaaacggcagaagcauuucuaggacauccagucacaaacgcaguaauaacaguuccagcauacuuuaacgauagucaaagacaagcaacgaaagaugcaggaguuauagcaggucuaaauguacuuaggauaaucaacgaaccaacggcagcagcaauagcauacggacuagauaaaggaggacaaggagaaagacauguacuaauauuugauuuaggcggaggaacauucgacguaaguauauuaaccauagaugauggaauauucgaaguaaaagcaacagcaggggacacacacuuaggaggcgaagacuucgauaacaggcuaguaagccauuuuguagaagaguucaaaagaaaacacaagaaagauauaucacaaaauaaacgcgcaguacgaagacucagaacagcuugcgaaagggcaaaaagaaccuuaagcucuaguacacaagcaaaccuggaaaucgauaguuuauacgaaggaauagauuucuauacaucaaucacuagagcuagauuugaagaacucugugcagaucuauuuagaggaacauuagaacccguagaaaaagcgcuuagagacgccaaaauggacaaagcaaaaauacaugacauaguccuaguagguggaaguacgcguauaccaaaaguacaaagauuauuacaggauuauuucaacggaagagaucuuaacaaaaguauaaaucccgaugaagcaguagcauacggugcagcaguacaggcagcaauacuaaugggagauaaaucugaaaaaguacaagacuuacuacuguuagacguagcaccacuuucacuaggacuagaaacagcuggagguguaaugacagcauuaauaaaaagaaauucaacuauaccaacuaaacaaacacaaauauuuacaaccuauagugacaaucaaccaggaguacuaauacaaguauaugaaggagaaagagcaaugacaaaagauaacaaucugcuaggaagauuugaucuaacgggaauaccaccagcaccaagaggaguaccacaaauagaaguaacguuugacauugaugcaaauggaauacuaaacgugaccgccacagauaaaaguacuggaaaagucaauaaaauaacuaucacaaacgauaaagggagacuaagcaaagaagagauagaaagaaugguuuuagaugcagaaaaauacaaagcagaagacgagguacaaagagagaaaauagcagcuaaaaaugcauuagaaucauaugcauuuaauaugaaaagcguaguaucagacgaaggauuaaaaggaaaaauaagcgaaagugauaaaaacaaaauacuagacaaaugcaaugaacuauuaucaugguuagaaguaaaucagcuagcagaaaaagaugaauuugaccauaaaagaaaggaacuagaacaaauguguaauccaauaauaacaaaauuauaccaaggggguugcacaggaccugcauguggaacaggauaugucccaggcagaccagcaacaggaccaacgaucgaagaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7380 - RNA, 2196 nt, Artificial Sequence
  mRNA product Design5 comprising derived and/or modified sequence from Homo sapiens__NP_068814.2 __HsHSPA2 (opt13)
gggagagucccgcagucggcguccagcggcucugcuuguucgugugugugucguugcaggccuuauucaagcuuaccaugucagcacgugggcccgcgauagguauagaucuagggacaacauacagcugcguugggguguuucaacacggaaaaguagaaauaauagcaaaugaucaagguaacagaaccacaccaaguuacguugcauuuacagauacugaaagguuaauaggagacgcagcgaaaaaccaaguagccaugaacccaacaaauacgaucuuugacgcaaaacgucuuauaggacguaaauuugaggacgcgaccguccaaagcgauaugaaacacuggccauuuagaguaguaagcgaaggaggaaaacccaagguacaaguagaauacaaaggagaaacaaaaaccuuuuucccugaagaaauaucaucaaugguauuaacaaaaaugaaagaaauagcagaagccuaccuugggggaaaaguccacucagcaguaauaacgguaccagcauacuuuaacgauagccagagacaagccacaaaagaugcagggacaauaacaggacucaauguauuaagaauaauuaaugagccuacagcagcagcaauagcauauggauuagauaagaaaggaugugcggguggggaaaagaacguauuaauauuugaccuagguggaggaacauucgacguaaguauacuaacaauagaagauggaaucuucgaagugaaaaguacagcaggagauacucaccugggcggagaagauuuugauaaucgaaugguuucacauuuagcagaagaguucaaacgaaagcacaagaaagauauaggaccaaacaaaagagcaguacgaagauugcgaacagcgugcgaaagagcgaaaagaacacugaguucaucaacacaagcgagcauagaaauagacucacuuuaugaaggaguagauuuuuauacaaguauaacacgcgcaagauuugaagaguuaaaugcagauuuauucagaggaacguuagaaccgguugagaaagcacuaagagacgcaaaacuugacaaaggccaaauacaagaaauaguauuagucggcggaucaacuagaauaccaaaaauacaaaaacuacugcaagacuucuuuaauggaaaagaacucaacaaaagcauaaauccagacgaagcagucgcauauggugcagcaguacaagcagcaauauuaauaggggauaaaucagaaaacgugcaagaucuacuguuacuagaugucacaccacuaucacuagguauagaaacagcaggggguguaaugacaccucuaauaaaaagaaauacaaccauuccaacaaaacaaacacaaacauuuacaaccuacucagauaaucaaucaagcguucuaguacaaguauaugaaggugaaagagcaaugacgaaggauaauaauuuauuaggaaaauucgaucucacagguauaccaccagcgccccgaggaguaccacaaauugaaguaacuuuugacauagaugcaaacggaaucuuaaauguuacagcagcagauaaaagcaccggaaaagaaaauaaaaucacuauaacgaaugauaaaggaagauuaagcaaagaugauauagauagaaugguacaagaagcggaaagauacaaaagugaagacgaagcaaauagagauagaguggcagccaaaaaugcacuagaaagcuauacauauaauaucaaacaaacagucgaagaugaaaaacuaagaggaaagauaucagaacaagauaaaaacaaaauauuggacaaaugucaagagguaauaaacugguuagauagaaaucaaauggcugaaaaggaugaauaugaacauaaacaaaaagaauuagaaagaguaugcaauccuauaauaucaaaacuauaucaaggaggaccaggaggaggaagcggaggaggaggaagcggcgcaucagguggaccaaccauagaggaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7381 - RNA, 2799 nt, Artificial Sequence
  mRNA product Design5 comprising derived and/or modified sequence from Homo sapiens__NP_002145.3 __HsHSPA4 (opt13)
gggagagucccgcagucggcguccagcggcucugcuuguucgugugugugucguugcaggccuuauucaagcuuaccaugaguguuguugguauugauuuaggcuuccaaagcugcuauguggcaguugcacgagcgggaggcauagaaacaauagcaaaugaauacagcgaucgaugcacccccgcauguaucucauucggaccuaaaaacagaucaaucggagcagcggcaaaaucacaaguaauuucaaaugcgaaaaacacuguacagggauucaaaagauuucauggaagggcauucagugacccauuuguagaagcugaaaagaguaacuuggcuuaugauauagugcaacuaccaaccggcuuaacaggaauaaaaguaacauacauggaagaagaaagaaacuuuacaacagaacaaguuaccgcaauguuacuuaguaaauuaaaagaaacugcagaaagcguguuaaagaaaccaguaguagauuguguugugaguguacccugcuuuuacacagaugcggaaaggagaucuguaauggacgcuacacaaauagcgggacuaaacugcuuaagacuaaugaaugaaacaacagcagucgcauuagccuacggcauuuauaaacaagacuuacccgcauuagaagaaaaaccaagaaacguaguuuuuguggacaugggacacucagcauaucaaguaucagugugugcauuuaauagaggcaaacuaaaaguauuagcaacagcauuugacaccacacuaggaggaaggaaauucgaugaaguacuuguaaaccauuucugugaagaguucggcaagaaauauaaacuagauauaaaaucaaaaauaagagccuuauuacgacuuucacaagaaugugaaaaauuaaagaaacugaugucagcaaaugccuccgaucugccacuaaguauagaaugcuucaugaaugauguagaugucucaggaacgaugaaccgcgguaaauuuuuagaaaugugcaaugaucuauuggcaaggguagaaccaccgcuuagaagcguccuagaacaaaccaaacuaaagaaagaagauauauaugcuguagaaauugucggaggagcaacaagaaucccagcaguaaaagagaaaauaaguaaauucuuuggaaaagaauuaucaacaacgcuaaaugcagacgaagccguaacacgaggaugcgcauuacagugugccauacuaaguccagcauucaaaguaagagaguucaguauaaccgacguuguaccauacccuauaaguuuaagguggaauagucccgcagaagaagguagcucagauugugaaguauuuucuaaaaaucacgcagcaccauuuucaaaaguauuaacauucuacagaaaagagccuuuuacacuagaggcuuauuauucaucaccccaagaccuaccauacccugauccagcuauagcacaauucagcguacaaaaagugacaccacaaagcgaugggaguagcucaaaaguaaaaguaaaaguaagagucaacguacauggaauauuuucaguaaguagugcaagccuaguagaaguacauaaaucagaagaaaaugaagaaccuauggaaacagaucaaaacgcgaaagaagaagagaaaaugcaaguugaucaagaagaaccccaugucgaagaacaacaacaacaaacaccagcugaaaauaaagcagaaagcgaggaaauggaaaccagccaagcuggauccaaagacaagaaaauggaucaaccaccccaagcaaagaaagcaaaaguaaaaacuagcacagucgacuuaccaauagaaaaccaacuccuauggcagaucgacagggaaaugcuaaaucucuauauagaaaaugagggaaaaaugauaaugcaggacaaacuagaaaaagagaggaacgacgcuaaaaacgcaguagaagaauacguauacgaaaugagagauaaacuaucaggggaauaugaaaaauuuguaucugaagaugauagaaacaguuuuacauuaaaauuggaagauacugaaaacugguuauacgaagauggcgaagaccaaccaaaacaaguauacgucgacaaacuagcugaacuaaagaaucuaggucaaccaauaaaaauaagauuccaagaaucagaagaaagaccaaaauuauucgaagaacuaggaaaacaaauacaacaauauaugaaaauaaucucaucauuuaaaaauaaagaagaccaauacgaccaucuagaugcagcagauaugacaaaaguagaaaaaucuacuaacgaagcaauggaauggaugaauaauaaauuaaaccuccaaaauaaacaaucacugacgauggaucccguuguuaaaagcaaagaaauagaggcaaaaauaaaagaacuaacaagcacguguagucccauaauaucaaaaccaaaaccaaaaguagaacccccaaaagaagaacagaaaaaugccgaacaaaaugguccaguagauggacaaggagacaauccaggcccacaagcagcagaacaaggaacagauacagccgugccaucagauagugacaagaaauuaccagaaauggauauugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7382 - RNA, 2796 nt, Artificial Sequence
  mRNA product Design5 comprising derived and/or modified sequence from Homo sapiens__NP_055093.2 __HsHSPA4L (opt13)
gggagagucccgcagucggcguccagcggcucugcuuguucgugugugugucguugcaggccuuauucaagcuuaccaugagcguuguuggcauagaucucggauuccuaaacugcuauauagccguagcuagaagcgguggaauagaaacaauagcgaacgaauacucggaccgcugcacaccagcuuguaucagcuuaggaucccgcaccagagcaauaggcaaugcagcgaaaagccaaauagugacaaacguacgaaauacuauacauggauuuaaaaaacuacacggaaggaguuucgaugacccuauaguacaaacggaaagaauacgacucccauaugaacuacaaaagaugccgaauggaagugcaggaguaaaaguaagauaccucgaagaagaaagacccuuugcaauugaacaaguaacuggaauguuacuagcaaaauuaaaagaaacaucggaaaacgcauuaaaaaaaccgguugccgacugcguaauauccaucccaaguuuuuuuacggaugcagaaagaagaaguguaauggcggcagcacaaguagcaggauuaaauugccuaaggcucaugaacgaaacgacagcaguagcuuuagcauacggaauuuauaaacaagauuugccaccauuagaugagaaacccagaaauguaguauucauagacaugggacacucugccuaucaaguacucguuugugcauucaauaaaggcaaauuaaaaguuuuagccacaacauucgaucccuaccucggcggaaggaauuucgacgaagcauuaguagauuauuuuugcgaugaauucaaaacaaaauacaaaauaaaugugaaagaaaacuccagagcauuacucagacuauaccaagaaugugaaaaacuaaaaaaacuaaugagcgcaaaugcaagcgaccucccccuaaacauagaaugcuuuaugaaugacuuggacguaucuucaaaaaugaacagagcccaauucgagcaauuaugcgcgucauuacuagcccgaguagaaccuccacuuaaagcaguaauggaacaagcaaacuuacaacgagaagauauaucaucuauagagauuguaggaggagcaacaagaauccccgcaguaaaagaacagaucacuaaguuuuuuuuaaaagacauuucuacaacacucaaugccgaugaagccguugcacgaggaugugcauuacaaugcgccauauuauccccagcauuuaagguaagagaauucagcauuacagaccugguuccauauucaauaacauuaagauggaaaacaaguuuugaagacggaucaggugaaugcgaaguauucugcaaaaaccauccagcaccauucucuaaaguaauuacauuccauaaaaaagaaccauuugaacuagaagcuuuuuauacuaaccuacacgaaguaccauacccagaugcaaggaucgguucauuuacaauacaaaacguguucccgcaaagcgacggagacucuaguaaagugaaaguuaaaguaagagucaauauacauggaauauuuucagucgccucagccucagugauagaaaaacagaacuuagaaggagaccauagugacgcuccuauggaaacugaaacauccuucaaaaaugaaaauaaagacaauauggauaaaaugcaaguagaccaggaagaaggacaucagaaaugccaugccgaacauacuccugaggaagaaauagaucauacaggagcaaaaacaaaaucggcaguaucagauaaacaagacagauuaaaucaaacucuaaaaaaagggaaaguuaaaucaauagacuuaccaauacaaucgagcuuaugcagacaguuaggacaagaccuacuuaacucauauauugaaaaugaaggcaaaaugauuaugcaagacaaauuagaaaaggagaggaacgaugccaaaaacgcagucgaagaauacguauaugacuucagagauagacuaggaacuguauaugaaaaauuuauuaccccagaagacuuaucgaaacuaagcgccguucuagaagauacagaaaacuggcuguaugaggauggagaagaucaacccaaacaaguauacguugacaaacuacaagaauugaaaaaauacggacaaccaauccaaaugaaauacauggaacacgaagaaagaccaaaagcauuaaaugaucucggaaaaaaaauccaauuaguaaugaaaguaauagaagccuaucguaauaaagaugaaagauacgaucaucuagacccuacagaaauggaaaaaguagaaaaauguauaucagaugcaaugaguugguuaaauucaaaaaugaacgcacaaaauaaacuaaguuuaacgcaagacccuguaguaaaagucucugaaaucguagcaaaaagcaaagaacuggacaacuucugcaaccccauaauauacaaacccaaaccuaaagcagaggugccagaagacaaacccaaagcaaauucugaacauaacgguccaauggacggacaaagcggaacagaaacaaaaucagacucaacaaaagauaguucacaacauacaaagucaucuggcgaaauggaaguugacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7383 - RNA, 2241 nt, Artificial Sequence
  mRNA product Design5 comprising derived and/or modified sequence from Homo sapiens__NP_005338.1__HsHSPA5 (opt13)
gggagagucccgcagucggcguccagcggcucugcuuguucgugugugugucguugcaggccuuauucaagcuuaccaugaaauuaucuuuaguagcggcaaugcuauuacuacuaagcgcagcaagggcagaggaagaagauaaaaaagaagacgucggaacaguagucgguauagaccuaggaaccacauauucaugcgucggaguuuuuaaaaacggaagaguugaaaucauagcaaacgaucaaggaaacagaaucacaccaucauacguagcguucacaccugaaggagaacgacucauaggagaugcagcaaaaaaucaauuaacaucuaacccugaaaacacagucuuugacgcaaaaagauugauaggaagaaccuggaacgacccuucaguucaacaagacauaaaauuucuaccauuuaaaguaguagaaaaaaaaacaaaaccauauauacaaguugauauuggaggcggucaaacaaaaacauucgcaccagaagaaauauccgcaaugguacuuacaaaaaugaaagaaacagcugaagcauaccuaggaaaaaaaguaacacaugccguaguaacaguaccagcauauuuuaaugacgcccaaagacaagcaacaaaggaugcaggaacaauagcuggucuaaacgucaugagaauaauaaacgaaccaacagcagcagcuaucgcauacggacuagauaaaagagaaggagaaaaaaauauacuaguauuugaucuaggaggaggaacauucgauguaagcuuauuaacaauagacaacggagucuuugaaguaguagcuacaaacggugacacacauuuaggaggagaagacuuugaucaaagaguuauggaacacuuuauaaaacuauauaaaaaaaaaaccgggaaagacguaaggaaagauaacagggccguacagaaacucagaagagaagucgaaaaagcaaaacgagcauuaucaucacaacaccaagcaagaauagaaauagaaaguuucuaugaaggagaagauuuuagcgaaacucuaacgcgagcaaaauuugaagagcugaacauggauuuauuuagaaguaccaugaaaccaguacaaaaaguacucgaagacagugauuuaaaaaaaagugacauagacgaaauaguccuaguaggagguucaacccgaauccccaaaauacaacaacucgucaaagaauuuuucaacggaaaagaaccgagccgaggaauaaacccugacgaagcaguagcauauggcgcagcaguucaagcaggcguauuaagcggagaucaagauacaggagauuuaguacuacuagacguauguccacuaacucuaggaauagaaacagucggaggaguaaugaccaaauuaauaccuagaaacacaguaguaccgacaaaaaaaucacaaauuuucuccacagcaagcgacaaucaaccaacaguaaccauaaaaguauacgaaggcgaaagaccauuaacaaaagauaaccauuuauuaggaacauuugauuuaacagguaucccaccugccccacgaggagucccacaaauagaaguuacauuugaaauagauguaaaugguauccucagagucacagcggaagauaaaggcacuggaaauaagaauaaaauuacuauaacaaacgaccaaaauagauuaacucccgaagaaauagaaagaaugguaaaugaugcggaaaaauucgccgaagaggacaaaaaacuaaaagagagaauagauaccagaaacgaguuagaaucauacgcauacucccuuaagaaucaaauuggagauaaagaaaaauuaggcggcaaauugagcucagaagacaaagaaaccauggaaaaagcaguagaagaaaaaauagaauggcuugaaagccaccaggaugcagauauagaagauuucaaagcaaaaaaaaaagagcuagaggaaaucguacaaccaauaauuucaaaacuauacggaagugcagggccaccaccaacaggagaagaagacaccgcagaaaaagaugaacuuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7384 - RNA, 2208 nt, Artificial Sequence
  mRNA product Design5 comprising derived and/or modified sequence from Homo sapiens__NP_002146.2__HsHSPA6 (opt13)
gggagagucccgcagucggcguccagcggcucugcuuguucgugugugugucguugcaggccuuauucaagcuuaccaugcaagcaccacgugaacuugcagucgguauagaucuaggaacaacauauuccuguguaggaguauuucaacaagggagaguagaaauauuagcaaacgaucaaggcaauagaacaacaccaucauauguagcauuuacugacacagaaagauugguaggagaugcagccaaaagucaagcagcauuaaauccacauaacacaguguucgacgcgaaaagacuaauugguagaaaauuugcggauacaacaguccaaagugacaugaagcauuggccauuuaggguagugucugaagguggaaaaccaaaaguaagaguaugcuauagaggugaagauaaaacauuuuauccagaagaaauuucaucaaugguauuaagcaaaaugaaagagacagcagaagcauaccuuggacaaccaguaaaacaugcuguaauaacaguucccgcauacuucaaugauagccaaagacaagcaacaaaagaugcuggagcaauagcuggauuaaacgugcuaagaauuauaaaugaaccaaccgccgcggcaauugcauauggauuagauagaagaggagcaggagaaagaaacguauuaauauucgaucuaggaggaggaacauuugacguaucagucuuaucaauagacgcaggcguauucgaaguaaaagcaacagcuggugauacucacuuaggaggagaagauuucgauaacagauuaguuaaucacuucauggaagaauuucgacgaaaacauggcaaagaucuauccggcaauaaaagagcauuaagaagacuacgaacagcgugugaaagagcaaaaagaacauuauccucaucuacccaagcuacauuagaaauagauagccuauucgaagggguagauuuuuacacuuccauaacaagagcucgcuucgaggaacuaugcucagauuuauuuagaucuacuuuagaaccuguagaaaaagccuuacgugacgcaaaauuagauaaagcacaaauacaugacgucguauuaguagguggaaguacccgaauaccaaaaguacaaaaacuauuacaagauuucuuuaacggaaaagaacuaaacaaaucaauuaauccagaugaagcaguugcuuacggcgcagcaguacaggcagcaguauuaaugggagauaaaugugaaaaaguacaagauuuguuacuucuagacguggcaccccuaagccuaggauuagaaacagcaggaggaguaaugaccacauuaauacaaagaaaugcaacaauaccuacuaaacaaacacaaacauuuacaacauauagugacaaucaaccugggguauucauacaaguauaugaaggugaaagagcaaugacaaaagauaauaauuuacuagguagauuugaauuaucagggauuccaccagcaccacgaggaguaccgcaaauagaggugacuuuugacauagacgcaaauggcaucuuaagcguaacagcaacagauagaagcacaggaaaagcaaacaaaauaacaauaacaaaugacaaaggaagguuaagcaaagaggaggucgaaaggaugguacaugaagcagagcaauauaaggccgaagaugaagcccaaagagacagaguagcagcuaaaaauucacuagaagcacauguguuucacguaaaagggagcuuacaagaagagaguuuaagagauaaaauaccagaagaagauagacgaaaaaugcaagauaaaugcagagaaguauuagcauggcuagaacauaaucaacuggcagaaaaagaagaauaugaacaucaaaaacgagaauuagaacaaauaugcagaccaauauucucaaggcuauauggcggaccaggaguaccaggaggaaguucuuguggaacucaagcuagacaaggagacccuucuacaggaccaauaauugaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7385 - RNA, 1380 nt, Artificial Sequence
  mRNA product Design5 comprising derived and/or modified sequence from Homo sapiens__P48741__HsHSPA7 (opt13)
gggagagucccgcagucggcguccagcggcucugcuuguucgugugugugucguugcaggccuuauucaagcuuaccaugcaagcacccagagaauuagccguaggaauagaccuaggaacuacauauagcugugucggaguauuucaacaaggaagaguugaaauauuagcaaaugaccaaggaaauagaacaacaccuucauauguagcauucacagacacagaaagguuaguaggagaugccgcgaaaagccaagcagcauuaaacccacacaauacaguauucgaugcaaaaagacucaucggaagaaaauuugcagauacaacaguacaaucagauaugaaacauuggccauuucaaguagucucagaaggcggaaaaccaaaaguaagaguauguuacagaggagaagauaaaacauuuuauccagaagaaauaucaaguaugguauuaucaaagaugaaagaaacagcagaagcauaucuaggccaaccaguaaaacaugcaguaauaacaguaccaacuuauuucucaaauucacaaagacaagcaacaaaagaugcuggagcaauugcaggucuaaaaguauuaccaaucauaaaugaagcuacagcugcagcaauagcauauggccuagauagaagaggagcaggaaaaagaaauguauuaauauuugauuuaggaggaggaaccuuugacguaucaguauuaucaauagaugcaggaguauuugaaguaaaagcaacagccggagauacacaucuaggaggagaagauuucgacaacagauuaguuaaucacuucauggaagaauuuagaagaaaacacggaaaagacuuaucagguaauaaaagagcacuuagaagauuaagaacagcaugugaaagagccaaaagaacaccaucaagcucaacacaagcgacauuagaaaucgauucacuauucgaaggaguagauuuuuauaaaucaauaacuagagcccgauuugaagaauuauguucagacuuauuucgaagcacacuagaaccaguagaaaaagcacuaagagaugcaaaacuagacaaagcacaaauacacgacuucguauuaggaggaggacuacacagucauccacaaggagcugaaguagcugcaggauuauuacaaagacaaggagcagaacaagaacaccaaccuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7386 - RNA, 2217 nt, Artificial Sequence
  mRNA product Design5 comprising derived and/or modified sequence from Homo sapiens__NP_006588.1 __HsHSPA8 (opt13)
gggagagucccgcagucggcguccagcggcucugcuuguucgugugugugucguugcaggccuuauucaagcuuaccaugucaaaagguccugcuguaggaauugacuuaggaacgacauauucguguguuggugucuuccaacaugggaaaguagaaauuauagcaaacgaucaaggaaaccgaacaacaccaucauacguagcuuuuacagauacagaaagauuaaucggagacgcggcuaaaaaucaaguagcaaugaauccaacaaacacagucuuugacgcaaaacgacuaauaggaagaagauuugaugaugcaguaguucaaagcgauaugaaacacuggccauuuaugguaguaaaugacgcaggaaggccaaaaguacaaguagaauacaaaggagaaacaaagagcuucuauccggaagaaguaucaagcaugguauuaacaaaaaugaaagagauagcagaggcauacuuaggaaaaacaguaacaaacgcaguagucacaguuccagcauauuucaacgauagccaaagacaagcaacaaaagacgcagguacaauagcaggauuaaauguacuccggauaauaaacgaaccaacagcugcugcaaucgcguauggacuagauaagaaaguaggcgcagaaagaaauguauuaaucuucgacuuaggaggaggaacauucgauguaucuauucuaacaauagaagacggcauauucgaaguaaaaagcacagccggcgacacacacuuaggaggagaagauuucgauaaccgaaugguaaaccauuucauagccgaguucaaaaggaaacacaagaaagacauaagugaaaauaaaagagcaguacgccgauuaagaaccgcaugugaaagagcaaaaagaacucuaaguucaagcacacaagcgaguauagaaauagacaguuuauaugaagguauagauuuuuauacaucaauaacaagagcaagauucgaagaacuuaacgcagaccuauuuagaggaacacuagacccaguagaaaaagcacuaagagaugcaaaauuagacaaaagccaaauacaugauauaguauuggucggaggaucgacuagaaucccaaaaauacaaaaacuauuacaagacuucuuuaacggaaaagaacucaauaaaucgauuaauccagaugaagcagucgcauauggagcugcgguacaagccgcgauauuaagcggagacaaauccgaaaacguccaagaucuauuacucuuagacguaacaccucugucgcuaggaauugaaacagccggugggguaaugacaguacuaauaaaaagaaacaccacaauaccaacuaaacaaacacaaacauuuacuacauacucagauaaucaaccaggaguccuaauucaaguuuacgaaggggaacgugcaaugacaaaagacaauaauuuacucggaaaauuugaacuaacaggaauaccaccagcaccaagaggaguaccacaaauagaaguaacauuugauauagaugcaaauggaauacuaaacguaagugcgguagauaaaagcacagguaaagaaaacaaaauaacaauaacuaacgacaaaggcagauuaucaaaagaagauauagaaagaauggugcaagaagcagaaaaauauaaagcagaagacgaaaaacaaagagauaaaguaaguaguaaaaauucauuagaaucauacgcauuuaauaugaaagcaacgguagaagaugaaaaauugcaaggaaaaauaaacgaugaagauaagcagaaaauuuuagacaaauguaacgaaauuauaaauugguuagauaaaaaucaaacagcagagaaagaggaauuugaacaucaacaaaaagaauuggaaaaggucugcaauccuauaauaaccaaauuauaccaaucugcgggaggaaugccaggcggaaugccaggaggauucccagguggaggagcuccaccaagcggaggagcaagcaguggaccaacaauagaagaagucgauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7387 - RNA, 2316 nt, Artificial Sequence
  mRNA product Design5 comprising derived and/or modified sequence from Homo sapiens__NP_004125.3 __HsHSPA9 (opt13)
gggagagucccgcagucggcguccagcggcucugcuuguucgugugugugucguugcaggccuuauucaagcuuaccaugaucagugcaagcagagcugccgcagcaagauuaguaggagcggcagcaagcagaggaccaaccgcugcuagacaucaagauaguuggaauggauuaucacacgaagcauuuagacucguaaguagacgagacuaugcaagcgaggcaauaaaaggcgcaguaguagggaucgauuuagggacgacaaacucaugcguagcagucauggaaggaaaacaagcaaaaguacuagaaaaugcagaaggagcgagaacaacaccaucaguaguagcguuuacugcagauggagaaaggcuaguaggcaugcccgcuaaaagacaagcaguaacaaauccaaauaauacauuuuaugcaacaaaaagauuaauaggaagaagauaugaugacccagagguacagaaagacaucaaaaauguaccuuuuaaaauaguaagagcaaguaacggagacgcauggguagaagcacaugguaaacuauauaguccgucgcaaauaggagcauuuguucuuaugaaaaugaaagaaacggcagaaaauuaucuagggcauacagccaagaacgcaguaauaacaguacccgcauauuucaacgauucacagcgucaagcaacgaaagaugcgggacaaauuagugggcugaauguauuaagaguaauaaacgaacccacagcugcagcccuagcguauggacucgauaaaucagaagacaaaguaaucgcaguauaugauuuaggugggggaaccuuugacauuucaauauuagaaauacaaaaaggcguauuugaaguaaaaaguacaaauggagauacauucuuaggaggagaagacuucgaucaagcucuauuacgacauauagugaaagaguucaaaagagaaacaggaguugacuuaacaaaagauaacauggcacuacaaagaguaagagaagcagcugaaaaagcgaaaugcgaacuaaguaguaguguacaaacagacauaaacuuaccauacuuaacaauggacucaucagggccaaaacaucuuaacaugaaacugacuagagcacaauucgaaggaauagucaccgaucuaauacguaggaccauugcaccaugccagaaagcaaugcaggacgcagaaguaucgaaaagcgauauaggagaaguaauauuaguugggggaaugacaagaaugccuaaaguacaacaaacaguacaagauuuauuuggaagggcaccaucaaaagcaguaaacccagacgaagcaguggcgauaggagccgcaauacaaggaggaguacuagcaggagacguaacugauguuuuauuacuagauguaaccccacuaaguuugggaauagaaacauuaggaggaguauuuacaaaacuaauaaauagaaauaccacaauaccuacaaagaaaucucaaguauuuucaacagcagcagacggccaaacacaaguggaaauaaaaguaugucaaggcgaaagagaaauggcaggagacaauaaacuguuaggacaauuuacuuuaauagguauaccaccagcaccaaggggaguaccucaaauugaaguaacauucgacauagacgcaaauggaauaguccauguaucagcgaaagauaagggcacagggagggaacaacaaauaguaauacaaaguagcggaggacugaguaaagacgauauagaaaauauggucaaaaaugcugaaaaauaugcugaagaggauaggaggaagaaagaaaggguagaagcgguaaauauggcagaaggaauaauacaugacacagaaacaaaaauggaagaauuuaaagaucaauuaccagcggaugaauguaauaaacucaaagaagaaauaaguaaaaugagagaguuacuugcaagaaaagauucagaaacgggagaaaauauacgacaagcagcaaguucacuacaacaagcuagucuaaaauuauucgaaauggccuauaagaaaauggcaucggaacgagaaggaucaggaucaucugguacaggggaacaaaaagaagaucaaaaagaagaaaaacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7388 - RNA, 2304 nt, Artificial Sequence
  mRNA product Design5 comprising derived and/or modified sequence from Homo sapiens__NP_079291.2__HsHSPA12A (opt13)
gggagagucccgcagucggcguccagcggcucugcuuguucgugugugugucguugcaggccuuauucaagcuuaccauggcugauaaagaagccggaggaucugauggcccuagagaaaccgcaccaacuucagcauauagcagccccgccagaucauuaggagauacaggcauaacucccuuaucaccaucccauauaguaaacgauacagauaguaaugucuccgaacaacaaucauuuuugguuguuguagcagucgauuucgguacaacaagcuccggauacgcauauuccuucacaaaagaaccggaauguauacauguuaugagaagaugggaaggcggcgacccaggaguuaguaaccaaaagacuccaacuacaauccucuuaacaccggaaaggaaauuccauucauucggauaugccgcacgcgauuuuuaccacgauuuagacccaaacgaagcgaaacaaugguuauaucuagaaaaauuuaaaaugaaacuacauaccacaggagaccuuacuauggauacagaccuaacagcugcaaauggaaagaaaguaaaagcauuagaaaucuuugcauacgcguuacaauacuuuaaagaacaagccuuaaaagaauuaagcgaccaagcuggaucagaauuugaaaauuccgacguacgaugggucauaacgguaccugcaauauggaaacaaccagcaaaacaauucaugagacaagccgccuaucaagcuggacuagcgucaccagaaaacagcgaacaacuaauaauagcacuagaaccagaagcagcaucaaucuauuguagaaaacuaagauuacaucaaaugauagaacuaucaucaaaagcugcaguaaauggauauucaggaagugacaccguaggugcaggauuuacucaagccaaagaacacauaagaagaaauagacaaucuagaaccuuucuagucgaaaauguaauuggcgaaauauggucugaauuagaagaaggagacaaauaugucguaguugacuccgguggaggaacaguggaucucaccguccaucaaauacgacuaccagaaggacaucuuaaagaacucuacaaagcuacaggaggaccauauggcucauuaggcguagauuaugaauuugaaaaacugcuauacaaaaucuucggagaagacuuuauagaacaauuuaaaaucaaaagaccagcagcauggguagauuuaaugauagcauucgaaucaagaaaaagagcugcagcaccagaucgaacuaauccguuaaauauaacguuaccauucucauucauugacuacuauaaaaaguuuagaggucauaguguugaacaugcacuaagaaaaucgaauguagauuuuguaaaauggucaagucaaggcauguuaagaaugucaccagaugccaugaaugcauuauuuaaaccaacuauagauucaauaauagaacauuuaagagacuuauuccaaaaaccagaaguaucuacaguuaaauucuuauuccuaguagggggauuugcagaagcuccacuucuacaacaagcagugcaagcagcauucggcgaccaaugucgaauaauaauaccucaagacguaggccucacaauacuaaaaggagcgguauuauuuggauuagauccugcagucauaaaaguaagaagaucaccucuaacauacgguguaggaguacuaaacagguacguagaaggaaaacacccaccugaaaaacuuuuagucaaagacggaacuagauggugcacagauguauuugauaaauucauaucagcagaucaaucaguagcauuaggagaacugguaaaacgaucauacacuccugcuaaacccagccaauuaguaaucguaauaaauauauauucaagugaacaugauaaugucucauuuauaacagauccaggaguaaagaaaugcggaacauugagauuggaccucacaggaacaucaggaacagcuguaccagcaagacgagaaauucaaacacuaaugcaauuuggagauaccgaaauaaaagcaacugcaauagauauagccaccagcaaaaguguaaaagugggaaucgauuucuuaaauuauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7389 - RNA, 2337 nt, Artificial Sequence
  mRNA product Design5 comprising derived and/or modified sequence from Homo sapiens__NP_443202.3 __HsHSPA12B (opt13)
gggagagucccgcagucggcguccagcggcucugcuuguucgugugugugucguugcaggccuuauucaagcuuaccaugcuagcaguaccugaaaugggauuacaaggucuauauauagguagcucgccagaacgaucaccaguaccaaguccgccgggaucaccucgcacacaagaaagcuguggaauugcaccacuaaccccuucucaaucaccaaagccagaaguuagagcaccccaacaggcuucauuuucuguaguaguagcaauagacuuuggcaccacauccucaggcuaugccuucagcuuugcaucagacccagaagcgauacauaugaugaggaaaugggaaggaggagauccagggguagcacaucagaaaacaccuacuugcuuauuacuaacaccagaaggcgcauuucauaguuuuggauauacagcaagagacuauuaucaugaucuggauccugaagaagcgcgugauugguuauauuuugaaaaauuuaaaaugaaaauccauucagcaacagaucuaacuuuaaaaacacaauuagaagcugucaauggcaaaacaaugccagcauuagaaguauuugcccaugcacuaagauuuuuccgagaacaugcacuacaagaacuuagagaacaauccccaaguuuaccugagaaagauacaguaagauggguauuaacagugccggcaauauggaaacaaccugcuaaacaauucaugagggaagccgccuauuuagcaggauugguuucacgagaaaacgcagaacaacuauugauagcuuuagagccagaggcggcaaguguauauuguagaaaacuaagauuacaucaacuacuagauuuaucaggcagagcuccaggaggagguagauuaggagaaagacgauccauugauucuaguuuuagacaagcuagagaacaacuaagaagaagcagacauucaagaacauuccuuguagaaaguggaguaggagaauuaugggcagaaaugcaagcaggagauagauauguaguugcagacuguggaggaggaacuguagaccucacaguucaucaacuagaacaaccacaugguacccuaaaagaauuauauaaagcgaguggcggcccauacggagcaguaggcguagauuuagcauuugaacaauuacucugucgaauauuuggagaagauuucauagcuacuuuuaaaagacaaagaccagcugcauggguagaucuaacuauagcuuucgaagcaagaaaaagaacagccggaccucauagagcaggagcauuaaauauaucucuaccauuuaguuuuauagauuuuuacagaaaacaacggggacauaacguagaaacggcauuacgaagaucaagugucaacuucguaaaauggucaucacaagguauguuaagaauguccugugaagcaaugaaugaacuauuucaacccacuguaagcggaauaauacaacacauagaagcauuauuagcaagacccgaaguucaaggaguaaaauuacuauuucuaguaggaggguuugccgaaucggcaguucuacaacaugcaguacaagcugcguuaggcgcacgaggauuacgaguaguaguaccccacgauguugggcuuacaauucugaaaggagcuguauuauuuggacaggcaccaggaguagucagaguuagaagaagcccacuaacauaugggguaggaguacuuaacagauuuguaccaggcaggcauccuccagaaaaauuauuaguacgagacggaagacguugguguacagauguauucgaaagauucguugcagcugaacaaagcguugcauuaggagaagaaguaagacgaucauauugcccagcuagaccaggucaaagaagaguucuaauaaacuuauauuguugcgccgcagaagaugcaagguuuauuacugauccuggaguucgaaaauguggugcacuuagccuagaacuagaaccggccgauuguggacaagauacagccggagcaccaccagguagaagagaaauaagagcugcuaugcaauucggagacaccgaaauaaaagucacagcaguagaugucagcacaaauagaucagugcgagcuaguauagacuuucuaucaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7390 - RNA, 1692 nt, Artificial Sequence
  mRNA product Design5 comprising derived and/or modified sequence from Homo sapiens__NP_008879.3__HsHSPA13 (opt13)
gggagagucccgcagucggcguccagcggcucugcuuguucgugugugugucguugcaggccuuauucaagcuuaccauggcacgagaaaugaccauauuaggaagcgccguauuaacauuauuacuagcgggauauuuagcacaacaauaucuaccccuacccacaccaaaaguaaucggaauagacuuaggaacaacauauuguaguguaggaguuuucuucccaggaaccggaaaagucaaaguaauaccagacgaaaacggacacauaucaauuccaucaaugguaucauuuacugauaacgacguauauguaggauacgaaucaguagaauuagccgauagcaauccacaaaacacuauauaugacgcaaaaagauucauaggcaaaauauuuacagcagaagaacuugaagcugaaauaggaagauaucccuuuaaaguacuaaauaaaaacggaaugguagaauucucaguuacaucaaaugaaacaauaacagucaguccagaauacguagguagcagauuacuacuaaaacuaaaagaaauggcagaagcauacuuaggaaugccaguagcaaaugccguaauaucuguaccagcagaauucgauuuaaaacaacgaaauucaacaauagaagcagcuaaucuagcaggacuaaaaauauuaagaguuauaaacgaacccacagcagcagcaauggccuauggauuacacaaagcugacguauuucauguacuaguaauagaucuagguggagguacauuagacguaagcuuacuaaauaaacaaggaggcauguuucuuacacgagcaaugucaggcaacaacaaauuaggaggucaagacuuuaaccaaagacuacuacaauaucucuacaaacaaauuuaccaaacuuauggauuuguuccuucaagaaaagaagaaauacaucgauuacgacaagcaguagagaugguaaaacuaaauuuaacacuacaucagagugcacaacuuuccgucuuauuaacaguugaagaacaagaucgaaaagaaccacacaguucagacaccgaacuuccaaaagauaaauuaagcucagcagaugaccauagaguuaacagcggcuuuggaagaggauuaucagacaaaaaaagcggagaaagccaagugcuguuugaaaccgaaauaagcagaaaauuauucgauacacuuaacgaagaccuauuccaaaaaauauuaguaccaauccaacaaguacuaaaagaaggucaucuagaaaaaacagaaauagaugagguaguauuaguaggaggaucaacacguauacccagaauaagacaaguaauacaggaauuuuucggaaaagauccaaauacaucaguagacccagauuuagcgguuguuacaggagucgcaauacaagcaggaauagauggcggaagcuggccauuacaaguauccgcacuagagaucccaaacaaacaucuacaaaaaaccaauuucaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7391 - RNA, 1806 nt, Artificial Sequence
  mRNA product Design5 comprising derived and/or modified sequence from Homo sapiens__NP_057383.2__HsHSPA14 (opt13)
gggagagucccgcagucggcguccagcggcucugcuuguucgugugugugucguugcaggccuuauucaagcuuaccauggcagcaauaggaguacauuuaggauguacaagugcauguguagcaguauauaaagauggaagagcaggaguaguagccaaugaugcaggggauagaguaacaccagcgguaguagcuuauucagaaaaugaagaaauaguaggauuagcugcaaaacaaucaagaauaagaaauauuaguaacaccguaaugaaagugaaacaaauacuaggaagaucuucaucagauccccaagcacaaaaauauauagcagaaucaaaaugucuaguaauagaaaaaaauggcaaacuaagauaugaaauagauacaggcgaagaaacaaaauuuguaaacccugaagaugucgcuagacuaauauucucaaaaaugaaagaaacagcacauucaguacuaggaucagaugcaaaugacguaguaauaaccguaccauuugauuuuggagaaaaacaaaaaaaugcauuaggagaagcagcaagagcagcaggauuuaacguguuacgacuuauacaugaacccucagcagcauuauuagccuauggaauaggucaagacucaccaacaggcaaaucaaauauauuaguauuuaaauuaggaggaacuagucuaucacucucaguaauggaaguaaauucaggaauauacagaguuuuaucaacuaauacagaugauaauauuggaggagcacauuuuacagaaacauuagcucaauaccuugcaagugaauuucaaagaaguuuuaaacacgaugucagaggaaaugcaagagcaaugaugaaacuaacgaauucagcagaaguagcaaaacauucauuaucaacauuagggucugccaauuguuuccuagauagucuuuaugaagggcaagacuuugacuguaauguaagucgagcaagauuugaacuacuguguucaccccuguuuaacaagugcauagaagcaauaaggggauuacuagaucaaaauggcuucaccgcagaugacaucaauaaaguaguacuauguggaggaagcucaagaauaccaaaacuccaacaauuaauaaaagauuuauuucccgcuguagaacuacuaaauaguauacccccagaugaaguaauaccaauaggugccgcaauagaagcaggcauauuaauaggcaaagagaaucuacuaguggaagacagucuaaugauagaauguagugcaagagacauauuaguaaaagggguagaugaaaguggagcaagcagauuuacaguauuauuccccagcggaacaccucuaccagcaagaagacaacauacucuacaagcgccagguucaauaucaucaguuugccuagaacuauacgaaucagacgguaaaaacucagcaaaagaagaaacaaaauucgcucaaguaguacuacaagauuuggacaaaaaagagaauggacuaagagauauucuagccguauugacuaugaaaagagauggaucacuacacguaacauguacagaccaagaaacaggaaaaugugaagcaaucucuauagaaauagccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7392 - RNA, 2853 nt, Artificial Sequence
  mRNA product Design5 comprising derived and/or modified sequence from Homo sapiens__NP_006635.2 __HsHSPH1 (opt13)
gggagagucccgcagucggcguccagcggcucugcuuguucgugugugugucguugcaggccuuauucaagcuuaccaugaguguuguggggcuagacguagggagccaaaguugcuauauagcaguagccagagccggaggaauagaaacgauagcaaaugaauucucagauagaugcaccccaaguguaauaucauucggaucaaaaaacaggacgauaggaguggcagccaaaaaucaacagauaacgcacgcaaauaacacagucagcaacuuuaaaagauuucacggaagagcauuuaacgacccauuuauacaaaaagaaaaagagaaucuaaguuacgacuuagucccccuaaaaaauggaggagugggaauaaaaguaauguauaugggcgaagaacaccuuuuuucaguugaacaaauaacugcgaugcuauuaacaaaacuaaaagaaacagcagaaaacucauuaaaaaaaccaguaacagacugcguaauaucaguaccaucauucuuuacagacgcugaacgacgaaguguucuagacgcagcacagauaguagguuugaauugucuaagacugaugaacgacaugacagcaguagcguuaaacuacggaauauacaaacaggaccuaccaagcuuggacgagaaaccuagaauaguaguauucguagacauggggcacucugcauuccaaguuagugcaugcgcauucaauaaagguaaacucaaaguauuaggaacagcauuugacccauucuuaggaggcaaaaacuuugacgaaaaacuuguugaacauuucugcgcggaauucaaaacaaaauauaaauuggacgccaaaagcaaaauaagagcccuuuuacgacuauaccaagagugcgaaaaacuaaaaaaacuaaugaguaguaauucaacugaccuaccacucaauauugaguguuucaugaaugauaaagauguaaguggcaaaaugaacagaucucaauucgaagaauuaugcgccgaauugcuacagaaaauagagguaccacuauauagccuccuagaacaaacacaucuaaaaguagaagauguuagugcaguggaaauaguaggaggcgcuacaagaauaccugcaguuaaagaaagaaucgcuaaauucuucggaaaagauauauccacaacacuuaaugcagacgaagcaguagcucgcggcugcgcucuccaaugugccauucuaaguccagccuucaaagucagagaauucucuguaacugacgcaguuccguucccuauaucacuuauauggaaccacgacagugaagauacugaaggagugcaugaaguauucagcaggaaccaugccgcuccuuucagcaaaguauuaacuuucuuacgaaggggaccauucgaauuagaagcauuuuacucagauccacaaggaguaccauacccugaagcaaaaauaggccgauucguaguacaaaacgucagcgcacaaaaagauggagaaaaaucaagagucaaaguaaagguacguguaaauacccacgguauuuucacaauaucaacagcauccaugguagaaaaaguaccuacagaagaaaaugaaaugucaagcgaagcagauauggaaugcuuaaaucaaagaccaccagaaaacccagauacagacaaaaacguacaacaagauaacucagaagcaggaacacaaccacaaguacaaaccgaugcucaacaaaccucacaaucaccuccaagcccagaacuuacuucugaagaaaacaaaaucccagacgcagauaaagccaacgaaaaaaaagucgaccaaccaccagaagcuaaaaaaccaaaaauaaaaguaguaaacguagaacugcccauagaagcaaaccuaguauggcaacuaggaaaagauuuauuaaacauguacauagaaacugaaggcaaaaugaucaugcaagauaaacuagaaaaagaacgcaaugacgcaaaaaacgcaguagaagaauauguauaugaauuuagagacaaauuauguggaccauaugaaaaauucauaugcgaacaagaucaccaaaauuuccuacgacuacucacugaaacagaagacugguuauaugaagaaggagaagaccaagcaaaacaagcuuacguagacaaacuggaagaacuaaugaaaauagguacgccuguaaaaguacguuuccaagaagcagaagaaagaccgaaaauguuugaagaauuaggacagagacuccaacacuaugcaaaaauagcugcagacuuccgaaacaaagaugaaaaauauaaccacauagaugaaagcgaaaugaaaaaaguugaaaaaucagucaacgaaguaauggaauggaugaacaacguaaugaaugcacaagcaaaaaaaagucuagaccaagacccaguagucagggcgcaagagauaaaaacgaaaaucaaagaauuaaauaacacuugcgaacccgucguaacgcaaccaaaaccuaaaauagaaucaccaaaacuagagcgcacgccuaaugguccaaacauagacaaaaaagaagaggaccuagaagauaaaaauaacuuuggugcagaacccccccaucaaaacggagaaugcuauccaaacgaaaaaaauaguguaaauauggaucuagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7393 - RNA, 3276 nt, Artificial Sequence
  mRNA product Design5 comprising derived and/or modified sequence from Homo sapiens__NP_006380.1 __HsHYOU1 (opt13)
gggagagucccgcagucggcguccagcggcucugcuuguucgugugugugucguugcaggccuuauucaagcuuaccauggcugauaaaguaagaagacaaagacccagaaggagaguuuguugggcucuaguagcaguauuacuggcagauuuauuagccuuaucagauacccuugcaguaauguccguagaccuaggaagugaaaguaugaaaguagcaauaguuaaacccggaguaccaauggaaauaguccuuaacaaagaaucuagaaggaaaacuccaguuauaguaacacuaaaagaaaaugaacgauucuucggcgacagugcagcaucaauggccaucaaaaauccaaaagcaacauuaagauacuuucaacaucuucuuggcaaacaagcugauaauccucaugucgcauuauaucaagcaagauuccccgaacacgaacuaacuuuugacccacaacgucaaacuguacacuuucaaauaaguucacaacuacaauuuaguccagaagaaguacucggaaugguccugaauuauucaagaucauuagcagaagauuucgcagaacaaccuauaaaagacgcaguaauaaccguuccuguguucuuuaaccaagccgaaaggcgagcaguauuacaagcagcucgaauggcaggauuaaaagucuuacaauugauaaaugauaauacagcaacagcacuuaguuacgggguauuuagacgaaaagauaucaauacgacagcucaaaauauaauguuuuaugacaugggaaguggcucaacagucugcacaauaguaacauaucaaauggucaaaacaaaagaagccgggaugcaaccacaacugcaaauacgagguguaggauucgauagaaccuuagggggacuagaaauggaauuaagauuacgagaaagauuagcaggauuauuuaacgaacaaaggaaaggccaacgugcaaaggauguaagagaaaauccaagagcgauggcaaaacuccugagagaggcuaauaggcuaaaaacggugcuaagcgcaaaugcggaccauauggcacaaauagaaggguuaauggaugacguagacuuuaaagccaaaguaacacgcguagaguucgaagaauuaugugcugaucuauuugaaagaguaccggguccaguucaacaagcguuacaaucggcagaaaugucacuugaugaaauagaacaaguaauuuuaguagggggcgcuaccaggguuccuaggguacaagaaguccuauugaaagccguggggaaagaagaauuagguaagaauauaaacgcagaugaagcugcugcaaugggugcaguguaucaagcagcagcacuaagcaaggcauuuaaggugaaaccguucguuguaagggaugcuguagucuauccaauauuaguagaauuuacucgcgaaguagaagaagaaccaggaauacauuccuuaaaacauaauaaaagagucuuauucagcaggaugggacccuauccucagagaaaaguaauaaccuucaaccgauacagucaugacuucaauuuccacauaaacuauggagauuuaggauuucuugguccggaagacuuaagaguauuuggaagucaaaaucuaacaaccguaaaauuaaaaggcgugggagacucauuuaagaaguaucccgauuacgaaucaaaaggaauuaaggcacauuuuaacuuagacgagagcggagucuuaagccuggacagaguggaaucaguauucgaaacguugguugaagauucagcugaagaagaaaguacacuaacgaaauugggaaacaccauaaguucucuauucggaggaggcacaacuccagaugcaaaagaaaaugguacagauacuguccaagaagaagaagaaucaccagcagaaggauccaaggacgaaccaggagagcaaguugaacuuaaagaagaagcagaagcacccguugaagauggaucacaaccuccaccacccgaaccgaaaggagacgccacgccggaaggagaaaaagcaacugaaaaagaaaauggagauaaaucagaagcacaaaaaccaucugaaaaagccgaggcaggaccagaagguguagcucccgcuccggaaggugaaaagaaacaaaaaccagcacgaaaaagacgcauggucgaagaaauaggaguagaauuaguaguuuuagacuuaccugaucucccagaagacaaacucgcacaaucaguacaaaaacuacaagaucuaacauugagagaucuggagaaacaagaaagagaaaaagcagcuaauagucuagaggcuuucauuuucgaaacccaagacaaauuauaccaaccugaauaccaggaaguuuccacagaagaacaaagggaagaaaucagugguaaauugagcgcagcuaguacaugguuagaagaugaaggaguuggagcaacgacaguaauguuaaaagaaaaauuagcagaauuaaggaaauuaugucaaggacucuucuuuagagucgaagaaagaaagaaauggcccgagagauugucagcauuagacaauuuauuaaaccauuccagcauguucuuaaaaggugccagacuuauaccagaaauggaucagauauuuacagaaguggaaaugacuacacuagaaaaaguaauuaacgaaaccugggcauggaaaaaugcaacacuagcagaacaagccaaauuaccggcgacggagaaaccaguacuauuaucgaaagauauagaagcaaaaaugauggcucuagaccgagaaguccaauaccuuuuaaacaaagccaaauuuacaaaaccaaggccaagaccuaaagacaaaaauggaacaagagcggaaccaccacuaaacgcgagcgcaagugaccaaggugaaaaaguaauuccaccagcuggacaaacagaagacgcugaacccauaagugaaccagaaaaaguagaaacaggaucagaacccggagauacugaaccacuagaguugggaggaccaggggcugagcccgaacaaaaagaacaaucaacaggccagaaaagaccgcucaaaaacgaugaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7394 - RNA, 2475 nt, Artificial Sequence
  mRNA product Design5 comprising derived and/or modified sequence from Homo sapiens__NP_005339.3 __HsHSP90AA1 (opt13)
gggagagucccgcagucggcguccagcggcucugcuuguucgugugugugucguugcaggccuuauucaagcuuaccaugccagaagaaacgcaaacacaggaccaaccaauggaagaagaagaaguugaaacauuugccuuccaagcugaaaucgcucaacuaaugucccucauaauaaacacauuuuacaguaauaaggaaauauuccuacgagaauuaauaucaaauaguagugacgcauuagauaaaauacguuacgaaagccuaacagauccgaguaaacuagacucaggaaaagaacuacacauaaacuuaauaccaaacaaacaagaccgaacacucacaauaguagacacagguauaggcaugacgaaagccgauuuaauaaacaaccucggaaccauugcaaaaagcggaaccaaggcauucauggaagcucuacaagcaggagcggacaucagcaugauaggccaguucggaguggguuucuauucagcauaccucguagcagaaaaaguaaccgucauaacgaagcacaacgacgaugaacaauaugcaugggaaucauccgccggaggaaguuucacaguccgaacugacacaggugaacccaugggaagagguacuaaaguaauccuucaucugaaagaagaucaaaccgaauaccucgaagaacgacgaauaaaagaaauuguaaaaaagcauucacaauucaucggauacccuauaacacucuucguagaaaaagaaagggauaaagaaguaagcgaugaugaagcagaagaaaaggaagacaaagaagaagaaaaagaaaaagaagaaaaagaaucagaagauaaaccagaaauagaagacguaggauccgacgaagaagaagaaaaaaaagacggugacaaaaaaaaaaaaaaaaagauaaaagaaaaauacauagaccaagaagaauuaaauaaaaccaaaccgauauggacgagaaaucccgacgacauaaccaacgaagaauacggagaauucuauaaaagccugaccaacgacugggaagaccaucuggcagucaaacacuucaguguagaaggacaauuagaauucagagcacuacuauuuguaccgagacgagcaccauucgacuuauucgaaaauagaaaaaaaaaaaacaacauaaaauuguacguaagaagggucuucauaauggacaauugugaagaacuaauacccgaauaucuaaacuucauuagaggcguuguagacucagaagaccuuccacucaauauaucaagagaaauguuacaacaaaguaaaauacugaagguaauaaggaaaaauuuaguaaaaaaaugcuuggaacuauucacagaacuagcagaagacaaagaaaacuacaaaaaauuuuaugaacaauucucaaaaaacauaaaguuaggaauucacgaagauagccaaaauagaaagaaacuaucugaauuguuacgauauuauacauccgcaucaggugacgaaauggugucguuaaaagauuacugcacacgaaugaaagaaaaccaaaaacauauauauuacauaacaggagaaacaaaagaucaaguagcaaacagcgcauucgucgaacgacugagaaagcacggauuagaaguaauauacaugauagaaccaauagaugaauauuguguacaacaauuaaaagaauucgaaggaaaaacucucguaucaguaacaaaggaaggacuugaacuaccagaagaugaagaagaaaaaaaaaaacaagaagaaaaaaagacaaaauuugaaaaccucugcaaaauaaugaaagacauacuggaaaaaaaaguagaaaaaguaguagucucaaacagacuagugaccucaccuuguuguauagucacaagcacauauggauggaccgcaaacauggaaagaauaaugaaagcacaagcauuaagagauaacucaacaauggguuacauggcagcuaaaaaacaucucgaaauaaauccagaucauucuauaauagaaacucuuagacaaaaagcagaagcagauaaaaacgacaagaguguaaaagacuuagucauacuauuauacgaaacggcacuacucagcaguggauuuaguuuagaagauccacaaacacacgcgaacaggaucuacagaaugauuaaacuaggauuaggaaucgaugaagaugacccaacagcagacgacacaucagcagcaguaacagaagaaaugccaccacuagaaggggacgaugacacuagccgaauggaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7395 - RNA, 615 nt, Artificial Sequence
  mRNA product Design5 comprising derived and/or modified sequence from Homo sapiens__NG_005218__HsHSP90AA3P (opt13)
gggagagucccgcagucggcguccagcggcucugcuuguucgugugugugucguugcaggccuuauucaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauucauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7396 - RNA, 2451 nt, Artificial Sequence
  mRNA product Design5 comprising derived and/or modified sequence from Homo sapiens__NP_031381.2__HsHSP90AB1 (opt13)
gggagagucccgcagucggcguccagcggcucugcuuguucgugugugugucguugcaggccuuauucaagcuuaccaugccagaagaaguacaucauggagaagaagaagucgaaacguuugcuuuccaagcggaaauagcgcaacuaaugagccuaauaauaaacacauucuauaguaacaaagaaaucuucuugagggaauuaauuucaaacgccuccgaugcauuagacaaaauaagauacgaaagcuuaacagacccaucaaaauuagauagcggaaaagagcuaaaaaucgacauaauaccuaacccacaagaacguacacugacacuuguagauacaggaauaggaaugacaaaagcagaccuaauaaacaaccuaggaacuauagcuaaaucaggcacgaaagccuucauggaagccuuacaagcaggagcagauauaucaaugauaggacaauuuggagugggauucuacagcgcauaccuaguagcagaaaaaguagucguaauaaccaaacauaaugacgacgaacaauacgcaugggaaagcucggcaggaggcagcuuuacaguaagagcagaucauggcgaaccuauaggaaggggcaccaaagucauccuacaucucaaagaagaucaaacagaauauuuagaagaaagacgagugaaagagguagucaaaaagcauucccaauuuauaggcuauccaauaaccuuauaccuagaaaaagaaagagaaaaagaaauaucagacgacgaagccgaagaagaaaaaggagaaaaagaagaagaagauaaagacgaugaagaaaaaccaaaaauagaagauguaggaagcgaugaagaagacgacucaggaaaagacaaaaaaaaaaagacaaaaaaaauaaaagaaaaauauaucgaucaagaagaacucaacaaaacaaaacccauauggacaagaaauccagacgacauaacacaggaagaauacggagaauucuauaaaagccuuacgaaugacugggaagaucaucuagcaguaaaacacuucucuguagaaggacaacuagaauuccgagcccuacuauucauaccaagacgcgcaccauucgaccuauucgaaaauaaaaaaaaaaaaaacaauauaaaauuauauguacggagaguguucauaauggacaguugcgaugaacuaauaccagaauacuuaaacuuuauaagaggagugguagacucagaagaccuaccccuaaauauaagccgggagauguuacaacaaagcaaaauauuaaaaguaaucaggaagaacauuguaaaaaaaugucuggaacuauuuucagaguuagcagaagauaaagaaaacuacaaaaaauucuacgaagcauucucaaaaaauuuaaaauuagggauacaugaagacagcacaaacagaagaagacugagcgaacuacuaagauaucauacaagucaaaguggagacgaaaugacuucacuaagugaauacguaucaagaaugaaagaaacacaaaaaucuauuuacuacauaacuggagaaucaaaagaacagguagcaaacagcgcauuugucgaacgaguaagaaaacgaggauucgaaguaguuuauaugacagaaccuaucgaugaauauugcguccaacaacuaaaagaauuugacggaaaaucacuugucaguguaacaaaagaaggacuagaacugcccgaagacgaagaagaaaaaaaaaaaauggaagaaucaaaggcuaaauucgaaaaucuaugcaaauuaaugaaagaaauacucgacaaaaaaguagaaaaaguaaccauaagcaaucgacuaguaucaaguccuugcuguauagucacaucaacauauggauggacagcgaauauggaaaggauaaugaaagcccaagcacuuagagacaauaguacaaugggauacaugauggccaaaaagcaucuagaaauaaauccugaccacccaaucguagaaacacuaagacaaaaagcagaagcagauaaaaacgacaaagcaguuaaagacuuaguugucuuauuauucgaaacagcacuacucucaaguggauucucacuagaagacccccaaacacauaguaacagaauauaccgaaugauuaaauugggauuaggaaucgacgaagacgaaguggcagccgaagaaccaaaugccgcaguacccgaugaaauaccaccccuagaaggagacgaagacgcaaguagaauggaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7397 - RNA, 2688 nt, Artificial Sequence
  mRNA product Design5 comprising derived and/or modified sequence from Homo sapiens__NP_003290.1__HsHSP90B1 (opt13)
gggagagucccgcagucggcguccagcggcucugcuuguucgugugugugucguugcaggccuuauucaagcuuaccaugagggcauuauggguucuaggacuauguugcguacuacuaacguucggaucaguaagagcagacgaugaaguagaugucgauggcacaguagaggaagaccuaggaaaaucaagagaaggaagccguacagacgacgaaguagugcaaagagaagaggaagcaauccaguuggauggacuaaaugcaagucaaauaagagaacuaagagaaaaaucagaaaaauucgcauuucaagcagaagugaacagaaugaugaaacuaauaaucaauucauuauauaaaaacaaagaaauauuccugagagaacuaauaagcaacgcaagugaugcuuuagauaaaauacgacuaauuagcuuaacagacgaaaaugcauuaagcggaaaugaagaguuaacaguaaaaauaaaaugugacaaagaaaaaaacuuacuccaugugacagacacaggaguaggaaugacccgcgaggaauugguaaaaaaucuaggaacgauagcuaaaagcggaacaagugaauuucuuaauaaaaugacagaagcacaagaagacggccaaucaacaagugaacuaauaggacaauucggaguugguuuuuauagugcuuuuuuaguugcugacaaaguaauagucacgucgaaacauaauaacgacacacaacacaucugggaaagugacucgaaugaauuuucaguuauagcagauccaagaggaaauacgcuaggcagagggacaacaauaacauuaguacuuaaagaagaagcaucagauuauuuagaauuagauacaauaaaaaaccuaguaaaaaaauauagucaauucauaaauuuccccauauauguauggaguaguaaaacagaaacgguagaagaaccaauggaagaagaagaagcagcuaaagaagaaaaagaggaaagugacgaugaagcagcaguugaagaagaagaagaagaaaaaaagccgaaaacuaaaaaagucgaaaaaacgguaugggacugggaacuuaugaacgauauaaagcccauauggcagagaccgagcaaagaaguagaagaagaugaauauaaagcauuuuacaaaucauuuaguaaagaaucagacgauccaauggcuuacauacauuuuacagccgagggagaaguaacauucaaaucaauuuuguuuguaccaacaagugcucccagagggcuauucgaugaauacggaucaaaaaaaagcgacuauauaaaacucuauguaagaagaguauucaucaccgacgacuuccacgauaugaugccuaaauaccuaaauuucguaaaaggagucguagauagugaugacuuaccauuaaauguaagcagagaaacucuccaacaacauaaauuacuaaaagugauacguaaaaaauuaguaagaaaaacacucgacaugauaaaaaaaauagcggaugauaaauauaaugauacauucuggaaagaauucggaacaaauauaaaacuuggcguaauagaagaucacucuaauagaacaagacuagcaaaacucuuaagguuccaaagcucacaucacccaaccgauauaacuucauuagaucaauauguagaaaggaugaaagaaaaacaagauaaaauauauuuuauggcaggaucaucaagaaaagaagcugaaaguagcccauucgucgaaagacuucuuaaaaaaggguaugaaguuauauauuugacagaaccaguagaugaauauuguauacaggcacuaccagaauucgaugguaaaagauuccaaaacguagcaaaagaaggcguaaaauucgacgaaagugagaaaacuaaggaaucacgagaagcgguagaaaaagaauucgagcccuuacucaauuggaugaaagacaaagcacuaaaagauaaaaucgaaaaagcuguggucagucaaagauuaacagaaucaccaugcgcauuaguugcaagucaauauggguggucaggaaauauggaaagaauaaugaaagcgcaagcauaucaaacuggaaaggauauaucgacuaacuacuacgcaucgcaaaagaaaacauucgaaauaaauccuagacacccauuaauaagagacaugcuacgaagaaucaaagaagaugaagacgacaagacaguacuagaucuagcaguaguauuauuugaaacagcaacauuaagaucggguuaccuucuuccggauacaaaagcauacggcgacagaauagaaagaaugcucagacuaucacucaacaucgacccagaugcaaaaguggaagaggaaccagaagaagaaccagaagaaacagcagaagauacgacagaagacacugaacaagaugaggacgaagaaauggacgugggaacugacgaagaagaagaaacugcaaaagaaagcacugcugagaaagaugaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7398 - RNA, 2391 nt, Artificial Sequence
  mRNA product Design5 comprising derived and/or modified sequence from Homo sapiens__NP_057376.2__HsTRAP1 (opt13)
gggagagucccgcagucggcguccagcggcucugcuuguucgugugugugucguugcaggccuuauucaagcuuaccauggcaagagaacuaagagcucuauuacucuggggaagaagacuacgaccauuauuaagagccccugcauuagcagcugucccaggcgguaaaccuauccuauguccaagaaggacgacagcgcaauuaggaccuagaagaaauccagcuuggagcuuacaagcagguagauuauuuaguacacaaacagcagaagauaaagaagaaccucuacauagcauaaucaguaguacagaaucuguacaaggaaguacaaguaaacacgaauuucaagccgaaacaaagaaacuccuugacaucguagcuagaagucuauauucagaaaaagaaguauucaucagggaauuaauuucaaaugcaucagaugccuuagaaaaacuaagacacaaacugguauccgauggacaagcccuaccagaaauggagauacauuuacaaacaaacgcagaaaaagguaccaucacaauccaggauacagguauaggcaugacucaagaagaacuuguuucuaaccuaggaacuauagcaagaucuggcaguaaagcauuccuagaugcuuuacaaaaccaagcagaagcaucuucaaaaauaauaggacaauuugguguaggauucuauagugcauuuaugguggcugaucguguagaaguuuauucacggucagcagcuccaggaucauuaggauaccaauggcuaucugaugguucaggagucuucgagauugcagaagcauccggaguaagaacaggcacaaaaaucauaauacaccuaaaaucugauugcaaagaauuuucuagcgaagcaagaguaagagauguagucacaaaauacuccaacuucgucucauucccacuauacuuaaauggcagacgaaugaauacucuacaagcuauauggaugauggauccaaaagauguccgggaauggcaacaugaagaguucuauagauacguugcucaagcucacgacaaaccacgauauacacuucauuacaaaaccgaugcaccacuuaauauaagaucaauauuuuauguaccagacaugaaaccaucuauguucgauguauccagagaauuaggaucaucuguagcauuauacucaagaaaaguguuaauacaaacuaaagcaacagauaucuuaccaaaauggcuucgauucauaagaggaguuguagauucagaagacaucccacuaaacuuaucgagagaauuacuacaagaaucagcacuuauuagaaaacuaagagauguccuacaacaaagauuaauaaaauucuuuauagaucaaucaaagaaagaugcagaaaaauacgcaaaauucuucgaagacuauggacuauuuaugagggaaggcauaguaacugcaacagaacaagaaguuaaagaagacauugcaaaacuacuaagauaugaaaguuccgcguuaccuucaggccaacucacgagucuaagcgaauaugcaagccgcaugcgugcaggaacuagaaacauauacuaccuaugugcgccuaacaggcaucucgcagaacauuccccuuacuacgaagcaaugaaaaagaaagauacagaaguacucuucugcuucgaacaauuugaugaacucacauuauuacaucuacgcgaguucgacaaaaagaaauuaauauccguagaaacagacaucgucguagaccacuauaaagaagaaaaauuugaagacagaucccccgcagcagaauguuuaagugaaaaagaaacagaagaauuaauggcauggaugagaaacguacuuggcucaagaguuacuaacguuaaaguaacucuacgacuagacacacauccugccaugguaacggucuuagaaaugggagcagcaagacacuuccuuagaaugcaacaauuagcaaaaacccaagaagaaagagcacaauuacuacaaccaacauuagaaaucaauccuaggcaugcauuaauaaagaaacuaaaccagcuuagagcaagcgaacccggucuugcacaacuauuaguagaucaaaucuaugaaaacgccaugauagcagcaggucuaguugacgaccccagagcaaugguagguagacuuaacgaacuacucgucaaagcauuagaaaggcauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7399 - RNA, 738 nt, Artificial Sequence
  mRNA product Design5 comprising derived and/or modified sequence from Homo sapiens__NP_000609.1__HsIGF1 (opt13)
gggagagucccgcagucggcguccagcggcucugcuuguucgugugugugucguugcaggccuuauucaagcuuaccaugggaaaaauaucaucacuaccuacacaacuauucaaaugcugcuucugcgacuuccuaaaaguaaaaaugcacacaaugucauccucacaccuauucuaccuagcacuaugccuacuaacauucacaucaucagcaacagccggaccagaaacacuaugcggagcagaacuaguagacgcauuacaauucguaugcggagacagaggauucuacuucaacaaaccaacaggauacggaucaucaucaagaagagcaccacaaacaggaauaguagacgaaugcuguuucagaucaugcgacuuaagaagacuagaaauguacugcgcaccauuaaaaccagcaaaaagcgcaagaucaguaagagcacaaagacauacagacaugccaaaaacacaaaaagaaguacaccuaaaaaacgcaucaagaggaucagcaggaaacaaaaacuacagaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7400 - RNA, 819 nt, Artificial Sequence
  mRNA product Design5 comprising derived and/or modified sequence from Homo sapiens__NP_000603.1__HsIGF2 (opt13)
gggagagucccgcagucggcguccagcggcucugcuuguucgugugugugucguugcaggccuuauucaagcuuaccaugggaauaccaaugggaaaaucaaugcuaguacuauuaacauuucuagccuucgcaucauguugcauagcagcauacagaccaagugaaacucuauguggaggagaauuaguagauacacuacaauuuguauguggagauagagguuucuauuucaguagaccagcaagcagaguaucaagaagaaguagaggaauaguagaagaaugcuguuucagaucaugugaccuagcacuacuagaaacauauugcgcaacaccagcaaaaucagaaagagauguaucaacaccaccaacaguauuaccagauaacuuuccaagauacccuguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccauuaauagcauuaccaacacaagauccagcacacggaggagcaccaccagaaauggcaucaaacagaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7401 - RNA, 915 nt, Artificial Sequence
  mRNA product Design5 comprising derived and/or modified sequence from Homo sapiens__NP_000591.1__HsIL6 (opt13)
gggagagucccgcagucggcguccagcggcucugcuuguucgugugugugucguugcaggccuuauucaagcuuaccaugaacucauuuucaacaucagcauucggaccaguagcauucucacuaggauuacuacuaguacuaccagcagcauucccagccccaguaccacccggagaagacuccaaagacguagccgccccacacagacaaccacuaacaucauccgaaagaauagauaaacaaauaagauacauacuagacggaaucucagcacuaagaaaagaaacaugcaacaaaucaaacaugugcgaaucaucaaaagaagcacuagcagaaaacaauuuaaaccuaccaaaaauggcagaaaaagacggcugcuuccaaucaggauucaaugaagaaaccugccuaguaaaaauaauaacaggauuacucgaauucgaaguauacuuagaauaccuacaaaacagauucgaaucaucagaagaacaagcaagagcaguacaaaugagcacaaaaguacucauacaauuccuacaaaaaaaagcaaaaaaucuagacgcaauaacaacaccagacccaacaacaaacgcaucacuacuaacaaaacuacaagcacaaaaccaauggcuacaagacaugacaacucaccuaauacucagauccuucaaagaauuucuacaauccucacuaagagcacuaagacaaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7402 - RNA, 1557 nt, Artificial Sequence
  mRNA product Design5 comprising derived and/or modified sequence from Homo sapiens__NP_002183.1__HsINHBA (opt13)
gggagagucccgcagucggcguccagcggcucugcuuguucgugugugugucguugcaggccuuauucaagcuuaccaugccauuacuaugguuaagagguuuucuauuagcaucaugcuggauaauaguaagaucaaguccaacaccaggaagugaaggucauagugcagcaccugacuguccuaguugcgcauuagcagcauuaccaaaagacguaccaaacagccagccagaaaugguagaagcaguaaaaaaacauauauuaaauaugcuacaucuaaaaaaaaggccagacguaacacaaccaguaccaaaagcggcuuuauuaaaugcaauaagaaaauuacauguagguaaaguaggagaaaacgguuacguagaaauagaggaugacauaggccgaagagcagaaaugaaugaacuaauggaacaaacaagugaaauaauaacauuugcagaaucaggaacagcaagaaaaacgcuacacuucgaaauaagcaaagaaggaagcgaucuuagugugguagaaagagcagaaguaugguuauuccugaagguacccaaagccaaucgaacgagaacaaaaguaacaauaagauuauuucaacaacaaaaacauccacaagguucacuagauacaggagaggaagccgaagaaguagguuuaaaaggagaaagaucugaauuauuauuguccgaaaaaguaguagaugccagaaaaaguaccuggcauguauuuccagugaguucaucaauacaaagauuacuagaucaagguaaaucaucacuagauguaagaauagcaugugaacaaugucaagaaaguggagcuaguuuaguacuauuaggaaagaaaaaaaaaaaggaggaagaaggagaaggaaaaaaaaaaggaggaggagaaggaggagcgggagcagaugaagaaaaagaacaaagucauagaccauucuuaauguuacaagcaagacaaagcgaagaucauccacacagaagaagacgacgaggacuagaaugcgauggaaaagucaauauauguuguaaaaaacaauuuuuuguaucauuuaaagacauaggauggaacgauuggauaauagcgccaucaggauaucacgcuaacuauugugaaggagaauguccaagccauauagcaggaacgaguggaagcucauuaucauuucacagcacgguaauaaaccauuauagaaugagaggacauagcccauuugcaaauuuaaaaucauguuguguaccuacaaaacuacguccaaugagcaugcuauauuacgacgacggacaaaauauuauaaagaaagauauccaaaauaugauaguagaagagugcggauguagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7403 - RNA, 1500 nt, Artificial Sequence
  mRNA product Design5 comprising derived and/or modified sequence from Homo sapiens__NP_002184.2__HsINHBB (opt13)
gggagagucccgcagucggcguccagcggcucugcuuguucgugugugugucguugcaggccuuauucaagcuuaccauggauggauuaccagggagagcauuaggagcagcaugucuauuauuauuagcagcagguugguuaggcccagaagcauggggaucuccaacaccaccaccaacaccagcagcacccccaccaccaccaccaccaggaaguccaggaggaagccaagauacauguacaagcugugguggauuuagaagaccagaagaauuaggaagaguagauggagacuuuuuagaagccguaaaaagacacauacuuucaagauuacaaaugagaggaaggccaaauauaacacaugcaguaccaaaggcagcaaugguuacagcauuaagaaaauuacacgcaggaaaaguaagagaagaugguagaguagaaauaccacauuuagacgggcacgcaucaccaggugcagaugggcaagaaagaguaagugagauaauuagcuuugcagaaacagauggauuagcaucaucaagaguacgauuauauuucuuuauaaguaacgaaggaaaucaaaaucuauucguagugcaagcaucacuaugguuauauuuaaaauuauugccauauguacuagaaaaaggaagcagaagaaagguaagaguuaaaguuuauuuucaagaacaaggucauggagaucgauggaauaugguagaaaaacgaguagauuuaaaaagaucaggauggcauacauuuccacuaacagaagcaauacaagcauuauucgaaagaggcgaaagaagacugaauuuagacgugcaaugugacucaugccaagaauuagcagugguuccagucuuuguagacccaggagaagaaagccauagaccauuuguaguaguacaagcaagacuaggagauaguagacauagaauaagaaaaagagguuuagaaugugacggaagaacaaauuuauguugcagacaacaauucuuuauugauuuuagguuaauagguuggaaugauuggauaauagcaccaacaggauauuauggaaauuauugugaaggaagcuguccagcauauuuagcugguguaccagguucagcuaguaguuuucacacagcaguagucaaucaauaucguaugcgaggauuaaauccugguacuguaaauagcuguuguauaccaacaaaacuaaguacaaugucaauguuauauuuugaugaugaauauaauauaguuaaaagagauguuccaaauaugauaguagaagaauguggaugcgcuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7404 - RNA, 3735 nt, Artificial Sequence
  mRNA product Design5 comprising derived and/or modified sequence from Homo sapiens__NP_000623.2__HsITGAM (opt13)
gggagagucccgcagucggcguccagcggcucugcuuguucgugugugugucguugcaggccuuauucaagcuuaccauggcauuacgagucuuacuuuuaacagcauuaacucugugccacggauuuaaucuugauacagaaaaugcaaugacauuucaagaaaacgcacgaggauuuggccagucgguaguacaguuacaggguagcaggguuguugucggugccccacaagaaauaguagcagccaaucaaagagguucacuauaccaaugugauuacucuacaggaaguugugagcccauaagauuacaaguacccgucgaagcagucaauaugucccuaggacuaaguuuagcagcaacaacuagcccaccacaauuacuagcuugcggcccaaccguacaccagacauguucugaaaauaccuaugucaaagguuuaugcuucuuauucgguaguaauuuaagacagcaaccacaaaaauuuccugaagcacuacgcggauguccucaagaagacuccgacauagcauuucuaauagacggaaguggcaguauaauaccccaugacuuuaggagaaugaaagaauuuguguccacaguaauggaacaacuaaagaaaucuaagacacuuuucucauuaaugcaauauagugaagaauuuagaauacauuucaccuucaaagaauuucaaaacaacccgaauccaagaucccuaguuaaaccaauaacccaguuacuaggaagaacacauacugccacaggcauucgaaaaguaguacgagaacuauuuaacauuacuaauggagcuagaaagaacgcuuucaaaauucuaguaguuauaacugauggagagaaauucggagacccucuuggauacgaagauguuauaccagaagccgauagagaaggagucauaagauauguaauaggaguaggcgaugccuuccgaagcgaaaaauccagacaggaacuaaauacaauagcuagcaaaccaccgagggaccacguuuuucaagucaauaauuuugaagcauuaaaaaccauucaaaaccaacuaagggagaaaauauucgcuauagaaggaacacaaaccggaucuaguaguagcuuugaacaugaaaugucccaagaagguuuuucugcugcgauaacuucaaauggcccacuacuaucaacagucgguaguuaugauugggccggaggaguauuccuuuauacaaguaaagaaaaaucaacauucauaaauaugacaagaguagacucugauaugaaugaugccuauuuaggauacgcagcagcaaucauacuacgcaacagaguccaaucacucguacuaggugcccccagauaccaacauaucggucuggucgcuauguuucgucaaaauacagguaugugggaaaguaaugcaaauguaaaagguacucaaauaggcgcauauuuuggugcuucauuaugcagcguugacguggauucgaacgguaguacagacuuaguguuaauaggcgcaccccacuacuacgaacaaacaagaggugggcagguaucaguaugcccucuacccagaggccgugccagauggcaaugugacgcaguacuauauggagaacaagggcaaccaugggguagauuuggggcugcauugacaguuuuaggagacguaaauggagauaaacuaacggauguugcuauaggagccccuggugaggaagauaauagaggagcgguauaccuauuucauggaacaucuggaaguggaauuucaccuagucacucacaaaggauagcaggauccaagcucuccccacgauuacaauauuuuggacagagccuaucgggaggucaagaucuaacuauggaugguuugguggaucucaccguaggcgcucaaggucaugugcuacuauuacgaucacaaccuguacuuagaguaaaagccauaauggaguucaacccaagagaaguagcucguaauguauucgaaugcaacgaucaaguuguaaaaggcaaagaagcaggagaagugcgugucugucuucauguucagaaaagcacacgugaucgauuaagagagggccaaauucaaucuguaguuacauacgacuuagccuuagacuccggacgaccacacucucgcgcagucuuuaaugaaacgaaaaacucaacacgaaggcaaacacaaguacuaggauuaacucaaacaugcgaaacccuuaaacuacaauuaccuaacuguaucgaagacccaguaucuccaaucguauugagacuaaauuuuuccuuaguaggcacaccacuuagugcuuuuggaaaucuaagaccggucuuagcagaagaugcucaaagauuauuuaccgcacuguucccauucgagaaaaacuguggaaacgauaauauaugccaagacgacuuaucuauuacauucucauucaugucguuagauugucuaguaguaggaggacccagagaauuuaauguaaccgucacaguucgaaaugacggagaagacucauauagaacccaaguaacauucuucuuuccguuagaucucagcuaucggaaaguaucaacauuacaaaaccaacgaagccaacgaucauggaggcucgcaugugaaagcgcuuccaguacggaaguaaguggagcacucaaaucuacaucuugcucuauuaaccacccaauauuuccggaaaacagugaggucacuuuuaauaucaccuucgacguagauagcaaagccaguuuaggaaauaaacuucuucucaaggcaaacguaacuucugaaaauaauaugccaagaaccaacaaaacagaguuccaacuagaauuaccagucaaauacgcaguauauaugguaguaacaagucauggaguuuccacgaaauaccuaaacuuuacugcaucagaaaacacaagcagaguaaugcaacaucaauaccaaguaucaaauuuaggacaacgaaguuuaccaauaucguuaguuuuccuggucccagucagauugaaucaaacaguaaucugggauagaccacaaguaacauuuucagaaaaucucucaucaaccugucauaccaaggaaagauuaccuucacauucagauuuucuagcagaacuacgcaaagcuccaguaguuaauugcucaaucgcaguaugucaaagaauacaaugugacaucccauucuuuggcauucaagaagaauuuaacgcuacauuaaaaggaaaucuuaguuuugauugguacaucaaaaccagucauaaccauuuacuaauagucucuacugcugaaauacuauuuaaugauucuguauuuacucuauuaccaggacaaggagcuuuuguucgaucacaaacagaaacuaaaguagaaccauucgaagucccaaauccauuaccauuaaucguggguucuucuguaggcggcuuauuacuuuuagcauuaauaacugcugccuuguauaaauuaggauuuuucaaaaggcaauauaaagauaugaugucugaaggagguccacccggagccgaaccacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7405 - RNA, 1680 nt, Artificial Sequence
  mRNA product Design5 comprising derived and/or modified sequence from Homo sapiens__NP_002415.1__HsMMP8 (opt13)
gggagagucccgcagucggcguccagcggcucugcuuguucgugugugugucguugcaggccuuauucaagcuuaccauguucucccucaaaacacuaccauucuuacuacuacuccauguacaaauauccaaagcauucccuguaucaucaaaagaaaaaaacacaaaaacaguacaagacuaccuagaaaaauucuaccaauuaccuucaaaccaauaccaaucaacaagaaaaaacggaacaaacguuauaguagaaaaacuaaaagaaaugcaacguuucuuugguuuaaauguaacagguaaaccaaacgaagaaacauuagacaugaugaaaaaaccaagauguggaguaccagacuccggcggauuuauguuaacaccaggaaauccaaaaugggaaagaacaaauuuaacuuaccgaauaagaaacuacacaccucaauuaagcgaagcagaaguagaaagagcaauaaaagaugccuucgaacuaugguccguagcaucaccucuaauuuucacaagaauaucacaaggagaagcagacaucaacauagcuuuuuaucaaagagaucacggagacaauucaccauuugauggaccaaacggaauccuagcacaugcauuucaacccggucaaggaauaggaggagacgcacacuucgaugccgaagaaacauggaccaacacuucagcaaacuacaaccuauuucuaguagcagcacaugaauucggccacucauuaggacucgcucauuccucagacccuggagcccuaauguaucccaacuaugcauucagagaaacaucaaacuauucacuaccucaagacgacauagauggaauucaagcuaucuacggauuaucaucaaacccaauucaaccaacaggaccaucaacacccaaaccuugugacccaucccuaacauuugacgcuauaacaacacuaagaggagaaauauuauucuucaaagacagauacuuuuggagaagacacccucaacuacaaagaguugaaaugaacuuuauaucauuauucuggccaucacuaccaacaggaauacaagcagcauacgaagacuucgauagagacuuaauauuccuuuucaaaggaaaccaauacugggcccuaaguggauacgacauauuacaagguuauccuaaagacauaucaaacuacggauuuccaucuucaguacaagcaauagacgcagcagucuucuauagaucaaaaacauacuuuuucguaaacgaccaauucuggagauaugacaaccaacgacaauuuauggaaccaggauauccaaaaucaauaucaggagcauucccuggaauagaauccaaaguagacgcaguauuucaacaagaacacuucuuccauguuuuuucaggaccaagauacuacgcuuuugacuuaauagcacaaagaguaacaagaguagcaagaggaaacaaauggcuaaacugccgauauggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7406 - RNA, 2400 nt, Artificial Sequence
  mRNA product Design5 comprising derived and/or modified sequence from Homo sapiens__NP_004985.2__HsMMP9 (opt13)
gggagagucccgcagucggcguccagcggcucugcuuguucgugugugugucguugcaggccuuauucaagcuuaccaugucauuauggcaaccauuaguuuugguacuuuuaguauuaggauguuguuuugcugcaccacgucaaagacaaaguacauuaguccuauuuccaggcgauuuaagaacaaauuuaacagacagacaacuugcagaagaauaucuauauagauaugguuauacaagaguagcugaaaugagaggugaaucaaaaucucuaggaccagcauuauuacuacuacaaaaacaguuaucacuaccagaaaccggggaacuagacucagcuacacuuaaagcaaugagaacuccacgguguggagucccagaucucggucgguuucaaacauuugaaggagaccuuaaauggcaucaucacaauauaacauauuggauacagaauuauucagaagaccuaccaagagcgguuauagacgacgcauucgcccgagcauuugcacuauggagugcuguaacaccauugacuuuuacaaggguauauagucgagaugcagauaucguaauacaauuugguguagcagagcauggggauggauacccuuuugacgguaaagacggacuucuagcacaugcauuuccaccaggaccuggaauacaaggagaugcccauuuugaugacgacgaacuauggagucuuggaaaaggagucguaguaccuacaagauuugguaaugcugauggugcagcaugucauuuuccuuuuauauuugaaggacgaucuuacucugcaugcacuacagauggacguucagauggauuaccaugguguucuacuacagccaauuaugauacagaugauagauuugguuuuuguccuucagaacgauuauauacgcaagauggaaaugcagauggaaaaccuugucaauucccauuuauauuucaaggacaaucauauucagcauguacaacagauggacgaagcgauggauaucgauggugugcaacaacagcuaacuacgacagagauaaauuauuugguuuuuguccaacucgcgcugacucaacagucaugggugguaauagcgcuggugaauuauguguauuuccauuuacuuuccuuggcaaagaauacucaacaugcacaucggaaggaagaggagauggacgauuauggugugcaacuacuaguaauuucgacagugacaaaaaauggggauuuuguccggaccaaggguauucacuuuucuuaguugcagcacacgaauucggucaugcacuuggccuagaccauucaucaguaccugaagcucuuauguacccaauguauagauuuacagaaggaccuccacuccauaaagacgaugucaacggcauacgccaucuauaugguccacguccagagccugaaccaaggccucccacaacaacaacaccacaaccuacugcuccaccuacaguaugcccgacuggcccaccaacaguacauccaucugaaagaccaacggccggaccaacgggaccuccuucagcggguccaacaggaccaccaacagcaggccccagcacugccacuacaguaccauuaucaccuguggacgaugcuuguaauguuaauauauuugaugcaauagcugaaauugguaaucaacuguauuuauuuaaagauggaaaauauuggcgauuuagugaaggacgcggaucuagaccccaaggaccauuucuaauugccgauaaauggccagcccuaccuagaaaauuagauucuguauuugaagaaagauuaucaaaaaaauuauuuuuuuucucaggaagacaaguauggguuuauacaggagcaucaguacuaggaccuagaagacuagauaaacuagguuuaggagccgacgucgcacaaguuacaggcgcccuaagaucaggaagaggaaaaauguuauuauucagcgguagaagauuauggagauuugaugugaaagcacaaaugguugauccaagaucagcuagcgaagucgaucgaauguucccagguguaccauuggauacucaugauguuuuucaauauagagaaaaagcauauuuuugucaagauagauuuuauuggcguguuucaucuaggagugaauuaaaccaaguggaucaaguaggauauguaacauacgauauacuacaauguccagaagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7407 - RNA, 1692 nt, Artificial Sequence
  mRNA product Design5 comprising derived and/or modified sequence from Homo sapiens__NP_002418.1__HsMMP13 (opt13)
gggagagucccgcagucggcguccagcggcucugcuuguucgugugugugucguugcaggccuuauucaagcuuaccaugcacccaggaguauuagcagcauuccucuucuuaucauggacacacugccgagcauuaccauuaccaucaggaggagacgaagacgaucuaucagaagaagaccuucaauucgcagaaagauacuuaagaucauacuaccacccaacaaacuuagcagguauacuaaaagaaaacgcagccucuucaaugacagaaagacuuagagaaaugcaaucauucuucggauuagaaguaacaggaaaauuagaugacaauacacuagauguaaugaaaaaaccuagaugcggaguuccugacguaggagaauauaacgucuuuccaagaacauuaaaaugguccaaaaugaaccuaacauauagaauaguaaacuauacaccagauaugacccauucagaagucgaaaaagcauucaaaaaagcauucaaaguauggucagauguaacaccucuaaacuucacaagacuacaugacggaauagcagacaucaugauaagcuuuggaauaaaagaacacggagauuucuacccauucgacggaccaucuggauuauuagcccacgcauuucccccaggaccaaauuauggaggagacgcacauuucgaugacgaugaaacauggacaucaucaucaaaaggauacaaccuauucuuaguagcagcacacgaauucggacacucuuuaggcuuagaccauucaaaagaccccggagcacuaauguucccaauauauacauauacaggaaaaagccacuucauguuaccagacgaugacguccaagguauacaaagucuauacggaccaggagaugaagauccuaacccaaaacauccaaaaaccccagacaaaugugauccaucauuaucauuagaugccauaacaucauuacgaggagaaacaaugauuuucaaagaccguuucuucuggcgucuucacccacaacaagucgacgcagaacucuuuuuaacaaaaucguuuuggccugaacuaccaaacagaauagaugcagcauacgaacacccuagucacgacuuaauauuuauuuuucgaggacgaaaauucugggcccuaaauggauacgauauauuagaaggauacccuaaaaaaauaucugaacuaggauuaccaaaagaaguaaaaaaaauaucagccgcaguccacuuugaagauacaggaaaaacacuucuauuuucaggcaaucaagucuggagauacgacgacacaaaccacauaauggacaaagacuaccccagauuaauagaagaagacuucccaggcauaggugacaaaguagacgcaguauacgaaaaaaacggauauauauauuucuucaacggaccaauacaauuugaauacucuauauggucaaacagaauaguaagaguaaugccagcaaacuccauuuuauggugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7408 - RNA, 1344 nt, Artificial Sequence
  mRNA product Design5 comprising derived and/or modified sequence from Homo sapiens__NP_001286.1__HsCCR1 (opt13)
gggagagucccgcagucggcguccagcggcucugcuuguucgugugugugucguugcaggccuuauucaagcuuaccauggaaacaccaaacacaacagaagacuacgauacaaccacagaauuugauuauggagacgcaacaccaugucaaaaaguaaacgaaagagccuuuggcgcgcaacuacuacccccauuauacucacuagucuucgucauaggacuaguagguaauauacuaguaguacuaguauuaguccaauacaaaagauuaaaaaauaugacaucaauauauuuacuaaacuuagcaauaucagauuuacuauuccuauucacauuaccauucuggaucgacuacaaacuaaaagacgacuggguauuuggagacgcaaugugcaaaauacucucaggauucuacuacacaggccuauacucugaaaucuucuucauaauacuacuaacaauagauagauaccuagcaauaguucaugcaguauucgcauuaagagccagaaccgucacauucggagucauaacaucaauaauaauaugggccuuagcaauauuagcaucaaugccaggacuauacuuuucuaaaacacaaugggaauucacacaucauacaugcucacuucacuucccucacgaaucccuaagagaauggaaacucuuccaagcauuaaaacucaaucuuuucggacuaguacuaccccuacucguaaugaucauaugcuacacaggaauaauaaaaauacuacuacgacgaccaaacgaaaaaaaaucaaaagcaguaagauuaauauucguaauaaugaucaucuucuuccuuuuuuggaccccuuacaaccucacaauacuaauaucaguauuccaagacuuuuuauucacacacgaaugugaacaauccagacaucucgacuuagcaguacaagucaccgaaguaauagcauacacacacuguugcguuaaccccguaauauacgcuuuuguaggagaaagauuccgaaaauaucuaagacaacuauuucacagacgaguugcaguacacuuagucaaaugguuaccauuucuaucaguagauagauuagaaagagucucauccacaucaccaucaaccggagaacacgaauuaucagcaggauucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7409 - RNA, 912 nt, Artificial Sequence
  mRNA product Design5 comprising derived and/or modified sequence from Homo sapiens__NP_002598.4__HsPDGFA (opt13)
gggagagucccgcagucggcguccagcggcucugcuuguucgugugugugucguugcaggccuuauucaagcuuaccaugagaacacuagcaugccuacuauuacuaggaugcggauaccuagcacauguacuagcugaagaagcagaaauaccaagagaaguaauagaaagacuagcaagaucacaaauacacucaauaagagaccuacaacgacuacuagaaauagacucagucggaagugaagacucacucgacacaagucuaagagcacacggaguacacgcaacaaaacacguaccagaaaaaagaccacuacccauaagaagaaaaagaagcauagaagaagcaguaccagcaguaugcaaaacacgaacaguaauauacgaaauaccaagaucacaaguagacccaacaucagcaaacuuccuaauauggcccccaugcguagaaguaaaaagaugcacaggaugcugcaacacaucaagcguaaaaugccaaccaagcaggguacaccacagaagcgucaaaguagcaaaaguagaauacguaagaaaaaaaccaaaacuaaaagaaguacaaguaagacuagaagaacaccuagaaugcgcaugugcaacaacaagccuaaauccagauuacagagaagaagacacaggaagaccaagagaaagcggaaaaaaaagaaaaagaaaaagacuaaaaccaacauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7410 - RNA, 1002 nt, Artificial Sequence
  mRNA product Design5 comprising derived and/or modified sequence from Homo sapiens__NP_002599.1__HsPDGFB (opt13)
gggagagucccgcagucggcguccagcggcucugcuuguucgugugugugucguugcaggccuuauucaagcuuaccaugaacagaugcugggcauuauucuuaucauuaugcuguuaccuaagauuaguaucagcagaaggagauccaauaccagaagaacuauacgaaaugcuaagcgaucacaguauaagaagcuuugacgaucuacaaagauuacuucacggcgauccaggagaagaagacggagcagaauuagaccuaaauaugacaagaucacacucaggaggagaauuagaaucacuagcacguggaagaagaagccuaggaagucuaacaauagcagaaccugcaaugauagcagaauguaaaacacgaacagaaguauucgaaauaucaagaagauuaauagauagaacaaaugcaaauuucuuaguauggccaccauguguagaaguacaaagaugcaguggaugcugcaauaacagaaacguacaauguagaccaacacaaguacaauuaagaccaguacaaguaagaaaaauagaaauaguaagaaaaaaaccaauauuuaaaaaagcaacagucacauuagaggaccaccucgcaugcaaaugugaaaccguagcagcagcaagaccaguaacaagaagcccaggcggaagccaagaacaaagagcaaaaacaccacaaacuagaguuacaauaagaacaguaagaguacgaaggcccccaaaaggaaaacauagaaaauucaaacacacacacgacaaaacagcacuaaaagaaacacuaggagcguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7411 - RNA, 1314 nt, Artificial Sequence
  mRNA product Design5 comprising derived and/or modified sequence from Homo sapiens__NP_057289.1__HsPDGFC (opt13)
gggagagucccgcagucggcguccagcggcucugcuuguucgugugugugucguugcaggccuuauucaagcuuaccaugucauuauuuggauuauuacuacuuacaucagcauuagcaggacaaagacaagguacacaagcagaaagcaaucuaucaagcaaauuccaauuuucauccaauaaagaacaaaauggaguacaagacccacaacacgaaagaauaauaaccgucagcacaaacggcucaauacauaguccacgauucccacauacauauccaagaaacaccguacucgucuggagauuaguagcaguugaagaaaauguauggauccaauuaacauucgacgaaagauuuggauuagaagacccugaagacgacauaugcaaauacgacuuuguagaaguagaagaaccaucagacggaacaauauuaggacgauggugcggaucagguacaguaccugguaaacaaaucucaaaaggcaaccaaauaagaauaagauucguaagcgaugaauacuucccaagugaaccaggauucuguauacauuacaauaucgucaugccacaauucacagaagcaguaucaccaucaguacuaccaccaucagcucuaccauuagacuuacuaaauaacgcuauaacagcauuuucaacauuagaagacuuaauacgauacuuagaaccagaaagauggcaacuagaccuagaagaccuauacaggccaacauggcaacuucuaggaaaagcauuuguauuuggaagaaaaucacgaguugucgaucuaaaccuauuaacagaagaaguaagacuuuacucaugcacaccaagaaacuuuucaguauccauaagagaagaacuaaaaagaacagauacaauauucuggccaggaugccuacuaguaaaaagaugcggcggaaauugcgcaugcugcuuacacaacuguaacgaaugccaaugcguaccaucaaaaguuacaaaaaaauaccacgaaguacuacaauuaagacccaaaacuggaguuagaggacuacauaaaucucuaacagacguagcacuagaacaucacgaagaaugugacugcguuugccgaggaagcacaggaggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7412 - RNA, 1371 nt, Artificial Sequence
  mRNA product Design5 comprising derived and/or modified sequence from Homo sapiens__NP_149126.1__HsPDGFD (opt13)
gggagagucccgcagucggcguccagcggcucugcuuguucgugugugugucguugcaggccuuauucaagcuuaccaugcacagauuaauauuuguauacacacuaauaugugcaaacuucugcucaugcagagacacauccgcaacuccacaaucagcaucaauaaaagcuuuaagaaacgcaaaucuaagaagagacgaucuauacagaagagacgaaaccauacaaguaaaaggaaacggcuacguacaaagcccacgauucccuaacucauacccaagaaaucuauuauuaacauggcgacuacacucccaagaaaacacaagaauacaacuaguauucgauaaccaauucggauuagaagaagcagaaaacgacauauguagauaugauuucguagaaguagaagacauaucagaaacaucaacuauaauacgaggaagauggugcggacacaaagaaguaccaccacgaauaaaaucaagaacaaaccaaauaaaaauaacuuucaaaucagaugacuacuucguugcaaaacccggauucaaaauauauuauagccuacuagaagacuuccaaccagcagcagcuucagaaacaaauugggaaucagucacaagcucaauaucaggaguaucauauaauagcccaucaguuacagacccaacacuaaucgccgacgcauuagacaaaaaaauagcagaauucgauacaguagaagaucuacuaaaauacuuuaacccugaaucauggcaagaagaucuagaaaacauguaucuagacacacccagauacagaggaagaagcuaccacgacagaaaaucaaaaguagacuuagacagacuaaaugaugacgcaaaaagauacucaugcacaccaagaaacuacagcguaaauauaagagaagaacuaaaauuagcaaacguaguauucuucccaagaugucuauuaguacaacgcugcggaggaaacuguggaugcggaacaguaaacuggcgaagcuguacaugcaauuccggaaaaacagucaaaaaauaccacgaaguacuacaauucgaacccggacauauaaaaagaagagguagagcaaaaacaauggcacuaguagauauacaauuagaccaccaugaaagaugcgauuguauaugcagcucuagaccuccaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7413 - RNA, 954 nt, Artificial Sequence
  mRNA product Design5 comprising derived and/or modified sequence from Homo sapiens__NP_003946.3__HsSOCS3 (opt13)
gggagagucccgcagucggcguccagcggcucugcuuguucgugugugugucguugcaggccuuauucaagcuuaccauggucacccauucaaaauucccagcagcaggaaugucaagaccauuagacacaucauuacgauuaaaaacauucucaucaaaaucagaauaccaacuaguaguaaaugcaguaagaaaacuacaagaaucaggauucuauuggucagcaguaacaggaggagaagcaaauuuauuacuaucagcagaaccagcaggaacuuuccuaauacgagacucaucagaccaacgacacuucuuuacucuaucaguaaaaacacaaucaggaacaaaaaaccucagaauacaaugugaaggaggaucauucucccuacaaucagaccccagaucaacacaacccguaccaagauucgacugcguacuaaaacuaguacaccacuacaugccaccacccggagcaccauccuucccaucuccaccaacagaaccaucaucugaaguaccugaacaaccaucagcacaaccacuaccuggaucaccaccaagaagagcauacuacauauacucaggaggagaaaaaauaccacuaguacuuucaagaccacuaucaucuaauguagcaacacuacaacacuuaugccgaaaaacaguaaacggccaccuagacucauacgaaaaagucacacaacuaccaggaccaauaagagaauucuuagaucaauacgacgcaccacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7414 - RNA, 759 nt, Artificial Sequence
  mRNA product Design5 comprising derived and/or modified sequence from Homo sapiens__NP_003227.1__HsTGFA (opt13)
gggagagucccgcagucggcguccagcggcucugcuuguucgugugugugucguugcaggccuuauucaagcuuaccaugguaccaucagcaggacaauuagcauuauuugcacuaggaauaguacuagcagcaugucaagcauuagaaaacucaacaucaccacuaucagcagacccaccaguagcagcagcaguaguaucacauuuuaaugauugcccagacucacacacacaauucugcuuucacggaacauguagauuucuaguacaagaagacaaaccagcauguguaugucauucaggauauguaggagcaagaugugaacaugcagauuuauuagcaguaguagcagcaucacaaaaaaaacaagcaauaacugcauuaguaguaguaaguauaguagcauuagcaguauuaauaauaacauguguauuaauacauugcugucaaguaagaaaacauugugaauggugcagagcauuaauauguagacaugaaaaaccuucagcauuacuaaaaggaagaacagcaugcugucacucagaaacaguaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7415 - RNA, 1449 nt, Artificial Sequence
  mRNA product Design5 comprising derived and/or modified sequence from Homo sapiens__NP_000651.3__HsTGFB1 (opt13)
gggagagucccgcagucggcguccagcggcucugcuuguucgugugugugucguugcaggccuuauucaagcuuaccaugccaccaucaggucuacgacuacuaccucucuuacuaccuuuacuauggcuccucguacuaaccccaggccgaccagcagcuggccuaucaacaugcaaaacaauagacauggaauuagucaaaagaaaaagaauagaagcaauuagaggacaaauacuaucaaaauuaagauuagccuccccaccuucucaaggagaaguaccaccagguccacuaccugaagcaguccuagcacuauacaacucaacaagagacagaguagcaggagaauccgcagaaccagaacccgaaccagaagcagacuauuaugcaaaagaagucaccagaguacuaaugguagaaacacauaaugaaaucuacgauaaauuuaaacaaucaacacauucaauauacauguuuuucaacacaagugaacuaagagaagcaguaccagaaccaguauuacuaucacgagccgaauuaagacuccuaagacuuaaacuaaaaguagaacaacacguugaauuauaccaaaaauacucuaacaacucauggagauacuuaucuaaucgacuacuagcacccucagacucaccagaauggcucucauucgacguaaccggaguaguacgacaauggcuaucccguggcggugaaauagaaggauucagacuauccgcacacugcucuugcgacucaagagacaauacauuacaaguagauauaaacggauucacaacaggaagaagaggagacuuagcuacaauccacggaaugaaccgccccuuccuacuauuaauggcaacuccucuagaaagagcacaacacuuacaauccucaagacacagaagagcacuagacacaaacuauuguuucucaagcacugaaaaaaacugcugcguccgacaauuauacauagacuuccgaaaagaucucggauggaaauggauacacgaaccaaaaggauaccacgccaacuucugccucgguccauguccauauaucuggucacuagauacacaauacuccaaaguacuagcauuauauaaccaacauaauccaggagcaucagcagcgccaugcugcguaccacaagcauuagaaccacucccaauaguauacuaugucggaagaaaaccaaaaguagaacaacuaucaaacaugauagucagaucaugcaaauguucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7416 - RNA, 1521 nt, Artificial Sequence
  mRNA product Design5 comprising derived and/or modified sequence from Homo sapiens__NP_003229.1__HsTGFB2 (opt13)
gggagagucccgcagucggcguccagcggcucugcuuguucgugugugugucguugcaggccuuauucaagcuuaccaugcacuauugcguacuuucagcauuucuaauauuacaccuaguaacagucgcuuuaaguuuaagcacaugcucaaccuuagacauggaccaauuuaugagaaaacgaauagaagcaauaagaggacaaauauuauccaaacuaaaacuaacaucaccacccgaagauuauccagaaccagaagaagucccaccagaaguaauaucaauauauaacagcacaagagaccuccuacaagaaaaagcaucaagaagagcagcagcaugcgaacgagaaagaucagaugaagaauauuacgcuaaagaaguauacaaaauagacaugccccccuucuuuccaucagaaaaugcaauaccaccaaccuuuuacagacccuauuuucgaauaguaagauucgauguaucagccauggaaaaaaacgcaucaaaccuagucaaagcggaauucagaguauuccgacuucaaaacccaaaagcuagaguucccgaacaacgaaucgaacuauaucaaauacuaaaaucaaaagaccuaaccucacccacacaaagauacauagacucaaaaguaguaaaaaccagagcagagggcgaaugguuaucauucgacguaacagacgcaguacacgaauggcuacaucacaaagaccgaaaucucggauucaaaauaucacuacacugcccaugcugcacauucgucccaucaaacaacuauauaauaccaaauaaaucagaagaacuugaagcaagauuugcuggaauagacggaacaaguacauacaccucuggagaccaaaaaacuauaaaaucaacaagaaaaaaaaacucuggcaaaacaccucaccuacuauuaaugcuacuacccucauacagacuagaaucacaacaaacaaaccgaagaaaaaaaagagcacuagacgcagcauacuguuucagaaacguacaagauaacugcugccucagaccacuauauauagacuucaaaagagaccuaggauggaaauggauacaugaaccaaaaggcuacaacgccaacuucugcgcaggagcaugcccauacuuauggucaucugacacacagcacucaagaguacuaucacuauacaacacaauaaauccagaagcuucagcaagucccugcugcguaucacaagacuuagaacccuuaacuauauuauauuauaucggaaaaacaccaaaaauagaacaacuaucaaacaugauaguaaaaucauguaaauguaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7417 - RNA, 1515 nt, Artificial Sequence
  mRNA product Design5 comprising derived and/or modified sequence from Homo sapiens__NP_003230.1__HsTGFB3 (opt13)
gggagagucccgcagucggcguccagcggcucugcuuguucgugugugugucguugcaggccuuauucaagcuuaccaugaaaaugcaccuccaaagagcccucgucguucucgcacuacuaaacuucgcaaccguaucacuaucccuaucaacaugcacaacccuagacuucggacacauaaaaaaaaaaagaguagaagcaauccgaggccaaauuuuaucaaaacuaagacuaacaucaccaccagaacccacagucaugacacacguaccauaccaaguccuagcacuauacaacucaacacgagaacuauuagaagaaaugcacggagaaagagaagaaggauguacacaagaaaacacugaaagugaauacuaugcaaaagaaauacacaaauucgauaugauacaaggacuagcagaacacaacgaacuagcaguaugcccaaaaggaauaacaucaaaaguauuucgauucaacguaucaucaguagagaaaaaucgaacaaaccuauuuagagccgaauuuagaguccuaagaguccccaauccaucaucaaaaagaaacgaacaacgcauagaacuauuucaaauacuacgcccagacgaacacauagcaaaacaaagauacauagguggaaaaaaccucccaaccagaggaacagccgaauggcuaucauucgacguaacagacaccgucagagaauggcuacuccgcagagaaucaaacuuaggucuagaaauaucaauacacugcccaugccauacauuucaaccaaauggagacauauuagaaaacauacaugaaguaauggaaaucaaauucaaaggaguagacaacgaagacgaccacggacgaggcgaccucggcagacuaaaaaaacaaaaagaucaccacaauccacaccuaauccuaaugaugauacccccccacagacuagacaacccaggacaaggaggacaacgaaaaaaaagagcacucgacacaaauuauuguuuccgaaaucuagaagaaaacugcugcguccguccacuuuacauagacuucagacaagaccuaggauggaaauggguucacgaaccaaaaggauauuaugccaacuucugcucaggacccugcccauacuuaagaucagcagacacaacacacucuacaguacuaggacuauacaacacacuaaacccagaagccucagcaucacccugcugugucccacaagaccuagaaccuuuaaccauacuauacuacguaggaagaacuccuaaaguagaacaacuuucaaauaugguaguaaaaucaugcaaaugcucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7418 - RNA, 1662 nt, Artificial Sequence
  mRNA product Design5 comprising derived and/or modified sequence from Homo sapiens__NP_001057.1__HsTNFRSF1B (opt13)
gggagagucccgcagucggcguccagcggcucugcuuguucgugugugugucguugcaggccuuauucaagcuuaccauggcaccaguagcaguaugggcagcacuugcaguaggacucgaauuaugggcagcagcacaugcauuaccugcacaaguugcauucacacccuacgcacccgaaccaggcucaaccuguagauuaagagaauauuacgaucaaacagcucaaaugugcuguucuaaaugcucaccuggccaacaugcaaaaguauuuugcacuaaaacaucugauaccguaugugauucuugugaagacucaacauauacacaacuauggaacuggguuccagaaugucuaucaugcggaucaagauguucaucagaccaaguugaaacacaagcauguacucgugaacaaaaucgaauuugcacauguagaccaggaugguauugcgcuuuaucgaaacaagaaggauguagacuaugcgcaccucuuagaaaaugcagaccaggcuuuggagucgcucgacccggaacugaaacaucagacguaguaugcaaaccuugugcaccagguacauucucuaacacaacaaguucaacagauauuuguagaccacaccaaauauguaacguaguugcuauaccaggaaacgcaucuauggaugcaguauguacaucuacgucaccuaccagaucaauggcaccaggagcaguucacuuaccacaaccaguaucaacaagaagucaacacacacaaccaacaccugaacccucaacugcaccaagcacuucauuucuacuaccaaugggucccucaccaccugcugaaggaucaacaggagacuucgcauuaccugucggacuuaucguaggaguuacagcauuaggacuauuaauaaucgguguaguaaauuguguuauuaugacacaaguaaaaaaaaaacccuuauguuuacaaagagaagccaaaguaccucauuuaccagcagauaaagccagaggaacccaagguccagaacaacaacauuuauuaaucacagcucccucaucaucaucaucaucuuuagaaucaucagcaagugcucuagauagaagagcucccacaagaaaccaaccucaagcaccaggugucgaagcaucaggagcuggugaagcucgugcuucuacgggaucuucagauucaucacccggaggacacggaacacaaguaaauguaacaugcauaguaaaugucuguuccaguucggaucauucaucacaauguucaucacaagcaucaucuacuaugggagauacagauaguucaccaucagaauccccaaaagacgaacaaguaccauuuucaaaagaagaaugcgcauuuagaucacaauuagaaacaccagaaacauuauuaggaucaacugaagaaaaaccacuaccacuaggcguaccagaugcaggaaugaaacccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7419 - RNA, 789 nt, Artificial Sequence
  mRNA product Design5 comprising derived and/or modified sequence from Homo sapiens__NP_002623.2__HsPGF (opt13)
gggagagucccgcagucggcguccagcggcucugcuuguucgugugugugucguugcaggccuuauucaagcuuaccaugccaguaaugagauuauuuccauguuucuuacaauuauuagcaggauuagcauuaccagcaguaccaccacaacaaugggcguuaucagcaggaaauggaaguagugaaguagaaguaguaccauuucaagaaguauggggaagaucauauuguagagcacuagaaagacuaguagauguaguaagugaauauccaagcgaaguagaacauauguuuucaccaucauguguaaguuuauuaagauguacgggaugcuguggagaugaaaauuuacauuguguaccaguagaaacagcaaauguaacaaugcaauuauuaaaaauaagaaguggagauagaccaucauauguagaauuaacauuuagccaacauguaagaugugaauguagaccauuaagagaaaaaaugaaaccagaaagaagaagaccaaaaggaagaggaaaaagaagaagagaaaaacaaagaccaacagauugucauuuauguggagaugcaguaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7420 - RNA, 1515 nt, Artificial Sequence
  mRNA product Design5 comprising derived and/or modified sequence from Homo sapiens__NP_001020537.2__HsVEGFA (opt13)
gggagagucccgcagucggcguccagcggcucugcuuguucgugugugugucguugcaggccuuauucaagcuuaccaugacagauagacaaacagauacagcgccaaguccaucauaccauuuauuaccaggaagaagaagaacaguagaugcagcagcgaguagaggacaaggaccagagccagcaccaggaggaggaguagaaggaguuggagcaagaggaguagcgcuaaaauuauuuguacaacuauuaggaugcaguagauucgguggagcaguaguaagagcuggagaagcagaaccauccggugcagccagaagcgcaaguaguggaagagaagaaccacaaccagaagaaggagaagaagaagaagaaaaagaagaggaaagaggaccacaauggagacuuggcgcuagaaaaccugggagcuggacaggagaagcagcuguaugcgcagauagugcaccagcagcaagagcaccacaagcauuagcaagagcaucaggacgaggaggaagaguagcaagaaggggagccgaagaaaguggaccuccacauaguccaaguagaagaggaucagcaaguagagcugggccaggaagggcaucugaaacaaugaauuuuuuauuaaguuggguacauuggaguuuagcuuuauugcuauauuuacaucacgcaaaauggagucaagcagcaccaauggcagaaggagggggacaaaaucaucacgaaguaguaaaauuuauggauguuuaucaaaggaguuauugucauccuauagaaacguuaguagauauauuucaagaauacccagaugaaauagaguauauauuuaaaccgaguuguguaccauuaaugagauguggaggauguuguaaugacgaaggacuagaauguguaccaacagaagaaagcaauauaacuaugcagauaaugagaauaaaaccucaucaaggacaacauauaggagaaaugaguuuuuugcaacacaauaagugcgaauguagaccaaaaaaagaucgagcaagacaagaaaaaaaaagcguaagagguaaagguaaaggacaaaaaagaaaaagaaaaaaaaguagauauaaaagcuggaguguauacguaggggcaagauguuguuugaugccauggagccucccaggaccucauccguguggaccauguucagagagaagaaaacaucuguuuguacaagauccacaaacauguaaaugcaguugcaaaaauacggauucaagauguaaagcgagacaauuagaauuaaaugaaaggacauguagaugcgauaagccgagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7421 - RNA, 975 nt, Artificial Sequence
  mRNA product Design5 comprising derived and/or modified sequence from Homo sapiens__NP_001165094.1__HsVEGFA (opt13)
gggagagucccgcagucggcguccagcggcucugcuuguucgugugugugucguugcaggccuuauucaagcuuaccaugaacuucuuacuaucauggguacauuggagcuuagcacuauuacuauaccuacaccacgcaaaauggucacaagcagcaccaauggcagaaggaggaggacaaaaccaccaugaaguaguaaaauucauggauguauaccaaagaucauacugccacccaauagaaacacuaguagacauauuccaagaauacccagacgaaauagaauacauauucaaaccaucauguguaccauuaaugagaugcggaggaugcugcaacgacgaaggacuagaauguguaccaacagaagaaaguaacauaacaaugcaaauaaugagaauaaaaccacaucaaggacaacacauaggagaaaugagcuuccuacaacacaauaaaugcgaaugcagaccaaaaaaagacagagcaagacaagaaaaaaaaaguguaagaggaaaaggaaaaggacaaaaaagaaaaagaaaaaaaucaagauacaaaucauggucaguauacguaggagcaagaugcugccuaaugccauggucacuaccaggaccacacccaugcggaccaugcucagaaagaagaaaacaccuauucguacaagacccacaaaccugcaaaugcaguugcaaaaacacagacagcagaugcaaagcaagacaauuagaacuaaacgaaagaacaugcagaugcgauaaaccacgaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7422 - RNA, 900 nt, Artificial Sequence
  mRNA product Design5 comprising derived and/or modified sequence from Homo sapiens__NP_003368.1__HsVEGFB (opt13)
gggagagucccgcagucggcguccagcggcucugcuuguucgugugugugucguugcaggccuuauucaagcuuaccaugucaccacuauuaagaagauuauuacuagcagcauuacuacaauuagcacccgcacaagcaccuguaucacaaccagaugcaccaggacaucaaagaaaaguaguaucauggauagacguauacacaagagcaacaugucaaccaagagaaguaguaguaccauuaacaguagaacuaaugggaacagucgcaaaacaacuaguaccaucaugcguaacaguacaaagaugcggaggcuguuguccagacgauggauuagaauguguuccaacaggacaacaucaaguaagaaugcaaauacuaaugauaagauacccaucaucucaacuaggagaaauguccuuagaagaacauagucaaugcgaaugcagaccaaaaaaaaaagauucagcaguaaaaccagaccgagcagcaacaccacaucauagaccacaaccacgaucaguaccaggcugggacucagccccaggagcaccaucaccagcagauauaacccaucccacaccugcaccaggaccaucugcacaugcagcaccuucaacaacaucagcauuaacaccaggaccagcagcagcagccgcagacgcagcugcaucaucaguagcaaaaggaggagcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7423 - RNA, 1536 nt, Artificial Sequence
  mRNA product Design5 comprising derived and/or modified sequence from Homo sapiens__NP_005420.1__HsVEGFC (opt13)
gggagagucccgcagucggcguccagcggcucugcuuguucgugugugugucguugcaggccuuauucaagcuuaccaugcaccucuuaggauucuucucaguagcuugcucauuauuagccgccgccuuauuaccaggaccaagagaagcaccagcagcagccgcagcauuugaaucaggauuagacuuaagugaugcugaaccagacgcaggagaagcuacagcauaugccaguaaagacuuagaagaacaauuaagaucaguaaguuccguagacgaauuaaugacaguacucuauccagaauacuggaaaauguauaaaugucaacuaagaaaaggcggauggcaacauaauagggaacaagcaaaucuaaauucaagaacagaagaaacuauaaaauucgcagccgcacacuauaacacggaaauacuaaaaaguauagauaacgaauggagaaaaacacaaugcaugccaagagaaguaugcauagauguaggaaaagaauuuggaguagcaacaaacacauuuuucaaaccaccauguguaagcguauacagauguggcgguugcugcaauagcgaaggauuacaauguaugaacacuagcacuucauacuuaucaaaaacacuauuugaaauuacaguaccauuaagucaaggaccuaaaccaguaacgauaaguuuugcaaaccacacaucauguagauguaugucaaaacuagauguauauagacaaguacacucaauaauaagaagaucacuaccagcaacacuuccacaaugccaagcagcaaauaaaacauguccaacaaacuauauguggaacaaccacauaugcagaugucuagcacaagaagauuucauguuuaguucagacgcaggagacgacagcacagauggauuucaugacauaugcggacccaacaaagaauuagacgaagaaacuugucaaugcguauguagagcaggacuacgaccagcaucauguggaccacauaaagaauuagacagaaacaguugccaaugcguaugcaaaaauaaacuauucccaucacaauguggagcaaaucgagaauuugaugaaaacacaugucaauguguaugcaaaagaacaugcccaagaaaucaaccauuaaauccagguaaaugcgcaugugaauguacagaaucaccacaaaaaugccuauuaaaaggaaagaaauuucaccaucaaacaugcaguuguuauagaagaccauguacaaauagacaaaaagccugugaaccaggauucuccuacucagaagaaguauguagauguguaccaaguuacuggaaaagaccacaaaugucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7424 - RNA, 1341 nt, Artificial Sequence
  mRNA product Design5 comprising derived and/or modified sequence from Homo sapiens__NP_004460.1__HsVEGFD (opt13)
gggagagucccgcagucggcguccagcggcucugcuuguucgugugugugucguugcaggccuuauucaagcuuaccauguaccgagaauggguaguaguaaacguauucaugaugcuuuacguacaacuaguacaaggaucaucaaaugaacacggaccaguaaaaagaucaagccaaucaacauuagaaagaucagaacaacaaauacgagcagcaucaucacucgaagaacuccuaagaauaacacacuccgaagacuggaaacuauggcgaugcagacuaagauuaaaaucauucacaucaauggauucacgcuccgcaucccacagaucaacaagauuugccgccacauuuuacgacauagaaacauuaaaagucaucgacgaagaauggcaacgaacacaaugcucaccuagagaaacaugcguagaaguagcaucagaacuagguaaauccacaaauaccuuuuuuaaaccaccuugcguaaacguauucagaugcggaggcuguugcaacgaagaaucacuaauuuguaugaacacaucuacauccuacauaucaaaacaacuauucgaaauaucaguaccacuaacaagcguacccgaacuaguccccguaaaaguagcaaaccacacaggaugcaaaugccuaccaacagcaccaagacauccauacuccauaauacgaagaucaauacaaauaccagaagaagacagaugcucacacucaaaaaaacuaugcccuauagauaugcuaugggacagcaacaaaugcaaaugcguacuacaagaagaaaacccucuagcaggaaccgaagaccacagccaucuacaagaaccagcauuaugcgguccacauaugauguucgacgaagacagaugcgaaugcguaugcaaaacaccaugccccaaagaccuuauacaacacccuaaaaacuguagcugcuuugaaugcaaagaaucacuagaaacaugcugccaaaaacacaaauuauuucacccagacacaugcucaugcgaagacagaugcccauuccacaccagaccaugcgcauccgguaaaacagcaugugcaaaacacugcagauuccccaaagaaaaaagagcagcccaaggaccacacucaagaaaaaauccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7425 - RNA, 1102 nt, Artificial Sequence
  mRNA product Design2 comprising derived and/or modified sequence from Artificial____ntGFP (wt) R5132
ggggcgcugccuacggagguggcagccaucuccuucucggcaucaagcuuuguugagugagcaagggcgaggagcuguucaccgggguggugcccauccuggucgagcuggacggcgacguaaacggccacaaguucagcguguccggcgagggcgagggcgugaccaccuacggcaagcugacccugaaguucaucugcaccaccggcaagcugcccgugcccuggcccacccucgugaccacccugaccuacggcgugcagugcuucagccgcuaccccgaccacugaaagcagcacgacuucuucaaguccgccugacccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucugagccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacugaguccugcuggaguucgugaccgccgccgggaucacucucggcugagacgagcuguacaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
